US012241100B2

(12) United States Patent
Liu et al.

(10) Patent No.: US 12,241,100 B2
(45) Date of Patent: Mar. 4, 2025

(54) ENGINEERED LEUCINE DECARBOXYLASES

(71) Applicant: Syntis Bio, Inc., Boston, MA (US)

(72) Inventors: Joyce Liu, Fremont, CA (US); Leann Quertinmont Teadt, Redwood City, CA (US); Nikki Dellas, San Carlos, CA (US); Stephan Jenne, Foster City, CA (US); Faye Loan Du, San Jose, CA (US); Kristen Jean Vallieu, Union City, CA (US); Kerryn McCluskie, Pacifica, CA (US)

(73) Assignee: SYNTIS BIO, INC., Boston, MA (US)

(*) Notice: Subject to any disclaimer, the term of this patent is extended or adjusted under 35 U.S.C. 154(b) by 149 days.

(21) Appl. No.: 17/166,934

(22) Filed: Feb. 3, 2021

(65) Prior Publication Data
US 2021/0238575 A1 Aug. 5, 2021

Related U.S. Application Data

(60) Provisional application No. 62/970,039, filed on Feb. 4, 2020.

(51) Int. Cl.
*C12N 9/88* (2006.01)
*A61K 38/00* (2006.01)

(52) U.S. Cl.
CPC ............... *C12N 9/88* (2013.01); *A61K 38/00* (2013.01); *C12Y 401/01014* (2013.01)

(58) Field of Classification Search
CPC ... A61K 38/00; C12N 9/88; C12Y 401/01014
See application file for complete search history.

(56) References Cited

U.S. PATENT DOCUMENTS

| | | |
|---|---|---|
| 5,605,793 A | 2/1997 | Stemmer |
| 5,811,238 A | 9/1998 | Stemmer et al. |
| 5,830,721 A | 11/1998 | Stemmer et al. |
| 5,834,252 A | 11/1998 | Stemmer et al. |
| 5,837,458 A | 11/1998 | Minshull et al. |
| 5,928,905 A | 7/1999 | Stemmer et al. |
| 6,096,548 A | 8/2000 | Stemmer |
| 6,117,679 A | 9/2000 | Stemmer |
| 6,132,970 A | 10/2000 | Stemmer |
| 6,165,793 A | 12/2000 | Stemmer |
| 6,180,406 B1 | 1/2001 | Stemmer |
| 6,251,674 B1 | 6/2001 | Tobin et al. |
| 6,265,201 B1 | 7/2001 | Wackett et al. |
| 6,277,638 B1 | 8/2001 | Stemmer |
| 6,287,861 B1 | 9/2001 | Stemmer et al. |
| 6,287,862 B1 | 9/2001 | delCardayre et al. |
| 6,291,242 B1 | 9/2001 | Stemmer |
| 6,297,053 B1 | 10/2001 | Stemmer |
| 6,303,344 B1 | 10/2001 | Patten et al. |
| 6,309,883 B1 | 10/2001 | Minshull et al. |
| 6,319,713 B1 | 11/2001 | Patten et al. |
| 6,319,714 B1 | 11/2001 | Crameri et al. |
| 6,323,030 B1 | 11/2001 | Stemmer |
| 6,326,204 B1 | 12/2001 | delCardayre et al. |
| 6,335,160 B1 | 1/2002 | Patten et al. |
| 6,335,198 B1 | 1/2002 | delCardayre et al. |
| 6,337,186 B1 | 1/2002 | Krebber |
| 6,344,356 B1 | 2/2002 | Stemmer |
| 6,352,859 B1 | 3/2002 | delCardayre et al. |
| 6,355,484 B1 | 3/2002 | Patten et al. |
| 6,358,740 B1 | 3/2002 | Patten et al. |
| 6,358,742 B1 | 3/2002 | Stemmer |
| 6,365,377 B1 | 4/2002 | Patten et al. |
| 6,365,408 B1 | 4/2002 | Stemmer |
| 6,368,861 B1 | 4/2002 | Crameri et al. |
| 6,372,497 B1 | 4/2002 | Stemmer |
| 6,376,246 B1 | 4/2002 | Crameri et al. |
| 6,379,964 B1 | 4/2002 | delCardayre et al. |
| 6,387,702 B1 | 5/2002 | Stemmer |

(Continued)

FOREIGN PATENT DOCUMENTS

| | | |
|---|---|---|
| WO | 95/22625 A1 | 8/1995 |
| WO | 95/33836 A1 | 12/1995 |

(Continued)

OTHER PUBLICATIONS

Taguchi, Y et al. "Purification of Histidine Decarboxylase from the Liver of Fetal Rats and Its Immunochemical and Immunohistochemical Characterization." The Journal of biological chemistry 259.8 (1984): 5214-5221. Web. (Year: 1984).*
Guo, Min et al. "Genomic Evolution of 11 Type Strains Within Family Planctomycetaceae." PloS one 9.1 (2014): e86752-e86752. Web. (Year: 2014).*
Tully, Benjamin J, Elaina D Graham, and John F Heidelberg. "The Reconstruction of 2,631 Draft Metagenome-Assembled Genomes from the Global Oceans." Scientific data 5.1 (2018): 170203-170203. Web. (Year: 2018).*
Strub C, Alies C, Lougarre A, Ladurantie C, Czaplicki J, Fournier D. Mutation of exposed hydrophobic amino acids to arginine to increase protein stability. BMC Biochem. Jul. 13, 2004;5:9. doi: 10.1186/1471-2091-5-9. PMID: 15251041; PMCID: PMC479692. (Year: 2004).*

(Continued)

*Primary Examiner* — Louise W Humphrey
*Assistant Examiner* — John Paul Selwanes
(74) *Attorney, Agent, or Firm* — MORRISON & FOERSTER LLP

(57) ABSTRACT

The present invention provides engineered leucine decarboxylase (LDC) polypeptides and compositions thereof, as well as polynucleotides encoding the engineered leucine decarboxylase (LDC) polypeptides. In some embodiments, the engineered LDC polypeptides are optimized to provide enhanced catalytic activity, as well as reduced sensitivity to proteolysis, and/or increased tolerance to low pH environments. In some embodiments, the engineered LDC polypeptides are optimized to provide improved storage stability. The present invention also provides methods for the use of the compositions comprising the engineered LDC polypeptides for therapeutic and industrial purposes.

6 Claims, No Drawings

Specification includes a Sequence Listing.

(56) References Cited

U.S. PATENT DOCUMENTS

| | | |
|---|---|---|
| 6,391,552 B2 | 5/2002 | Stemmer |
| 6,391,640 B1 | 5/2002 | Minshull et al. |
| 6,395,547 B1 | 5/2002 | Stemmer |
| 6,406,855 B1 | 6/2002 | Patten et al. |
| 6,406,910 B1 | 6/2002 | Patten et al. |
| 6,413,745 B1 | 7/2002 | Patten et al. |
| 6,413,774 B1 | 7/2002 | Stemmer |
| 6,420,175 B1 | 7/2002 | Stemmer |
| 6,423,542 B1 | 7/2002 | Crameri et al. |
| 6,426,224 B1 | 7/2002 | Crameri et al. |
| 6,436,675 B1 | 8/2002 | Welch et al. |
| 6,444,468 B1 | 9/2002 | Stemmer et al. |
| 6,455,253 B1 | 9/2002 | Patten et al. |
| 6,479,652 B1 | 11/2002 | Crameri et al. |
| 6,482,647 B1 | 11/2002 | Stemmer |
| 6,483,011 B1 | 11/2002 | Stemmer et al. |
| 6,484,105 B2 | 11/2002 | Zhang |
| 6,489,146 B2 | 12/2002 | Stemmer et al. |
| 6,500,617 B1 | 12/2002 | Stemmer et al. |
| 6,500,639 B2 | 12/2002 | Subramanian |
| 6,506,602 B1 | 1/2003 | Stemmer |
| 6,506,603 B1 | 1/2003 | Stemmer |
| 6,518,065 B1 | 2/2003 | Stemmer |
| 6,519,065 B1 | 2/2003 | Colbourne et al. |
| 6,521,453 B1 | 2/2003 | Crameri et al. |
| 6,528,311 B1 | 3/2003 | delCardayre et al. |
| 6,537,746 B2 | 3/2003 | Arnold et al. |
| 6,573,098 B1 | 6/2003 | Stemmer |
| 6,576,467 B1 | 6/2003 | Stemmer |
| 6,579,678 B1 | 6/2003 | Patten et al. |
| 6,586,182 B1 | 7/2003 | Patten et al. |
| 6,602,986 B1 | 8/2003 | Stemmer et al. |
| 6,605,430 B1 | 8/2003 | Affholter et al. |
| 6,613,514 B2 | 9/2003 | Patten et al. |
| 6,653,072 B1 | 11/2003 | Patten et al. |
| 6,703,240 B1 | 3/2004 | Stemmer et al. |
| 6,716,631 B1 | 4/2004 | delCardayre et al. |
| 6,825,001 B2 | 11/2004 | Wackett et al. |
| 6,686,515 B1 | 12/2004 | Lassner et al. |
| 6,902,922 B2 | 6/2005 | Ness et al. |
| 6,917,882 B2 | 7/2005 | Selifonov et al. |
| 6,946,296 B2 | 9/2005 | Patten et al. |
| 6,961,664 B2 | 11/2005 | Selifonov et al. |
| 6,995,017 B1 | 2/2006 | Stemmer |
| 7,012,312 B2 | 3/2006 | Iwasaki |
| 7,024,312 B1 | 4/2006 | Selifonov et al. |
| 7,058,515 B1 | 6/2006 | Selifonov et al. |
| 7,105,297 B2 | 9/2006 | Minshull et al. |
| 7,148,054 B2 | 12/2006 | delCardayre et al. |
| 7,220,566 B2 | 5/2007 | Ness et al. |
| 7,288,375 B2 | 10/2007 | Stemmer et al. |
| 7,384,387 B1 | 6/2008 | Raillard et al. |
| 7,421,347 B2 | 9/2008 | Selifonov et al. |
| 7,430,477 B2 | 9/2008 | Selifonov et al. |
| 7,462,469 B2 | 12/2008 | Bass et al. |
| 7,531,341 B1 | 5/2009 | Vellard et al. |
| 7,534,564 B2 | 5/2009 | Patten et al. |
| 7,534,595 B2 | 5/2009 | Vellard et al. |
| 7,553,653 B2 | 6/2009 | Kakkis et al. |
| 7,560,263 B2 | 7/2009 | Kakkis et al. |
| 7,620,500 B2 | 11/2009 | Mundorff et al. |
| 7,620,502 B2 | 11/2009 | Selifonov et al. |
| 7,629,157 B2 | 12/2009 | Davis et al. |
| 7,629,170 B2 | 12/2009 | delCardayre et al. |
| 7,702,464 B1 | 4/2010 | Emig et al. |
| 7,747,391 B2 | 6/2010 | Gustafsson et al. |
| 7,747,393 B2 | 6/2010 | Fox |
| 7,751,986 B2 | 7/2010 | Gustafsson et al. |
| 7,776,598 B2 | 8/2010 | Patten et al. |
| 7,783,428 B2 | 8/2010 | Gustafsson et al. |
| 7,795,030 B2 | 9/2010 | Minshull et al. |
| 7,853,410 B2 | 12/2010 | Selifonov et al. |
| 7,868,138 B2 | 1/2011 | Stemmer et al. |
| 7,873,477 B1 | 1/2011 | Gustafsson et al. |
| 7,873,499 B2 | 1/2011 | Selifonov et al. |
| 7,904,249 B2 | 3/2011 | Selifonov et al. |
| 7,957,912 B2 | 6/2011 | Selifonov et al. |
| 7,981,614 B2 | 7/2011 | Stemmer et al. |
| 8,014,961 B2 | 9/2011 | Bass et al. |
| 8,029,988 B2 | 10/2011 | Crameri et al. |
| 8,048,674 B2 | 11/2011 | Minshull et al. |
| 8,058,001 B2 | 11/2011 | Crameri et al. |
| 8,076,138 B2 | 12/2011 | delCardayre et al. |
| 8,108,150 B2 | 1/2012 | Mundorff et al. |
| 8,170,806 B2 | 5/2012 | Selifonov et al. |
| 8,224,580 B2 | 7/2012 | Mundorff et al. |
| 8,377,681 B2 | 2/2013 | delCardayre et al. |
| 8,383,346 B2 | 2/2013 | Colbeck et al. |
| 8,457,903 B1 | 6/2013 | Emig et al. |
| 8,504,498 B2 | 8/2013 | Fox |
| 8,589,085 B2 | 11/2013 | Selifonov et al. |
| 8,762,066 B2 | 6/2014 | Fox |
| 8,768,871 B2 | 7/2014 | Fox |
| 9,593,326 B2 | 3/2017 | Clark et al. |
| 9,665,694 B2 | 5/2017 | Cope |
| 9,684,771 B2 | 6/2017 | Cope et al. |
| 2005/0260724 A1 | 11/2005 | Ben-Bassat et al. |
| 2008/0220990 A1 | 9/2008 | Fox |
| 2009/0312196 A1 | 12/2009 | Colbeck et al. |
| 2011/0082055 A1 | 4/2011 | Fox et al. |
| 2012/0177722 A1 | 7/2012 | Weiner et al. |
| 2013/0005012 A1 | 1/2013 | Yu |
| 2013/0039898 A1 | 2/2013 | Okhamafe et al. |
| 2013/0340119 A1 | 12/2013 | Plesch et al. |
| 2014/0005057 A1 | 1/2014 | Clark et al. |
| 2014/0214391 A1 | 7/2014 | Cope |
| 2014/0221216 A1 | 8/2014 | Cope et al. |
| 2015/0050658 A1 | 2/2015 | Cho |
| 2015/0133307 A1 | 5/2015 | Zhang et al. |
| 2015/0134315 A1 | 5/2015 | Sarmiento et al. |
| 2016/0244787 A1 | 8/2016 | Chan et al. |
| 2023/0277635 A1 | 9/2023 | Asfaha |
| 2024/0018504 A1 | 1/2024 | Liu |

FOREIGN PATENT DOCUMENTS

| | | |
|---|---|---|
| WO | 96/00787 A1 | 1/1996 |
| WO | 97/0078 A1 | 1/1997 |
| WO | 97/35966 A1 | 10/1997 |
| WO | 98/27230 A1 | 6/1998 |
| WO | 2000/42651 A1 | 7/2000 |
| WO | 2001/75767 A2 | 10/2001 |
| WO | 2009/152336 A1 | 12/2009 |
| WO | 2012/122333 A1 | 9/2012 |
| WO | 2016201380 A1 | 12/2016 |
| WO | 2021158686 A1 | 8/2021 |
| WO | 2023077169 A2 | 5/2023 |

OTHER PUBLICATIONS

Dalcin Martins P, Danczak RE, Roux S, Frank J, Borton MA, Wolfe RA, Burris MN, Wilkins MJ. Viral and metabolic controls on high rates of microbial sulfur and carbon cycling in wetland ecosystems. Microbiome. Aug. 7, 2018;6(1):138. doi: 10.1186/s40168-018-0522-4. PMID: 30086797; PMCID: PMC6081815. (Year: 2018).*

UniProtKB Accession No. A0A2N3UZI5 dated Apr. 25, 2018.

Ambertos, A., et al., "The mouse Gm853 gene encodes a novel enzyme: Leucine decarboxylase," BBA-General Subjects, 1862(3): 365-376 [2018].

International Search Report from PCT Application No. PCT/US21/16450 dated Jul. 12, 2021.

Altschul, S., et al., "Basic local alignment search tool," J. Mol. Biol., 215: 403-410 [1990].

Altschul, S.F., et al., "Gapped Blast and PSI-Blast: a new generation of protein database search programs," Nucleic Acids Res., 25(17):3389-3402 [1997].

Beaucage, S.L., et al., "Deoxynucleoside phosphoamidites—A new class of key intermediates for deoxypolynucleotide synthesis," Tetrahedron Letters, 22(20):1859-62 [1981].

Black, M.E., et al., "Creation of drug-specific herpes simplex virus type 1 thymidine kinase mutants for gene therapy," Proc Natl Acad Sci USA, 93:3525-3529 [1996].

(56) References Cited

OTHER PUBLICATIONS

Botstein, D., et al., "Strategies and applications of in vitro mutagenesis," Science, 229(4719):1193-1201 [1985].
Caldwell, R.C., et al., "Mutagenic PCR," PCR Methods Appl., 3:S136-S140 [1994].
Carter, P., "Site-directed mutagenesis," Biochem. J., 237:1-7 [1986].
Christians, F.C., et al., "Directed evolution of thymidine kinase for AZT phosphorylation using DNA family shuffling," Nat. Biotechnol., 17:259-264 [1999].
Crameri, A., et al., "DNA shuffling of a family of genes from diverse species accelerates directed evolution", Nature, 391:288-291 [1998].
Crameri, A., et al., "Improved green fluorescent protein by molecular evolution using DNA shuffling," Nat. Biotechnol., 14(3):315-319 [1996].
Crameri, A., et al., "Molecular evolution of an arsenate detoxification pathway by DNA shuffling," Nat. Biotechnol., 15(5):436-438 [1997].
Dale, S.J., et al., "Oligonucleotide-directed random mutagenesis using the phosphorothioate method," Methods Mol. Biol., 57:369-74 [1996].
De Boer, H.A., et al., "The tac promoter: A functional hybrid derived from the trp and lac promoters," Proc. Natl Acad. Sci. USA, 80: 21-25 [1983].
Guo, Z., et al., "3'-End-Forming Signals of Yeast mRNA," Mol. Cell. Biol., 15(11):5983-5990 [1995].
Henikoff, S.,et al., "Amino acid substitution matrices from protein blocks," Proc. Natl. Acad. Sci., 89:10915-10919 [1992].
Ikeda, K., et al., "Phenylalanine ammonia-lyase modified with polyethylene glycol: Potential therapeutic agent for phenylketonuria," Amino Acids, 29:283-287 [2005].
Kramer, B., et al., "Different base/base mismatches are corrected with different efficiencies by the methyl-directed DNA mismatch-repair system of *E. coli*," Cell, 38(3):879-887, [1984].
Ling, M., et al., "Approaches to DNA Mutagenesis:An Overview," Anal. Biochem., 254:157-78 [1997].
Matthes, H.W.D., et al., "Simultaneous rapid chemical synthesis of over one hundred oligonucleotides on a microscale," EMBO J., 3(4):801-05 [1984].
Menkes, J.H., et al., "A New Syndrome: Progressive Familial Infantile Cerebral Dysfunction Associated With an Unusual Urinary Substance," Pediatrics, 14:462-467 [1954].
Minshull, J., et al., "Protein evolution by molecular breeding," Curr. Op. Chem. Biol., 3(3):284-290 [1999].
Needleman, S., et al., "A general method applicable to the search for similarities in the amino acid sequence of two proteins," J. Mol. Biol. 48:443-453 [1970].
Pearson, W.R., "Improved tools for biological sequence comparison," Proc. Nat'l. Acad. Sci. USA, 85:2444-2448 [1988].
Romanos, M.A., et al., "Foreign gene expression in yeast: a review," Yeast 8:423-488 [1992].
Schadewaldt, P., et al., "Metabolism of branched-chain amino acids in maple syrup urine disease," Eur. J. Pediatr., 156(Suppl. 1): S62-66 [1997].

Simonen, M., et al., "Protein Secretion in *Bacillus* Species," Microbiological Reviews, 57:109-137 (1993).
Skvorak, K.J., "Animal models of maple syrup urine disease," Inherit. Metab. Dis., 32(2):229-46 [2009].
Smith, M., "In vitro mutagenesis," Ann. Rev. Genet., 19:423-462 [1985].
Smith, T., et al., "Comparison of Biosequences," Adv. Appl. Math, 2:482-489 [1981].
Stemmer, W., "DNA Shuffling by Random Fragmentation and Reassembly: In vitro Recombination for Molecular Evolution," Proc. Natl. Acad. Sci. USA, 91:10747-10751 [1994].
Stemmer, W.P.C., "Rapid evolution of a protein in vitro by DNA shuffling", Nature, 370:389-391 [1994].
Villa-Komaroff, L., et al., "A bacterial clone synthesizing proinsulin," Proc. Natl Acad. Sci. USA, 75(8): 3727-3731 [1978].
Wells, J.A., et al., "Cassette mutagenesis: an efficient method for generation of multiple mutations at defined sites," Gene, 34:315-323 [1985].
Zhang, J-H., et al., "Directed evolution of a fucosidase from a galactosidase by DNA shuffling and screening ," Proc. Nat. Acad. Sci., U.S.A., 94:4504-4509 [1997].
Zhao, H., et al., "Molecular evolution by staggered extension process (StEP) in vitro recombination," Nat. Biotechnol., 16:258-261 [1998].
GenBank Accession No. RPI63066.1 dated Nov. 25, 2018.
NCBI Accession No. WP_051769113.1 dated Jan. 13, 2018.
NCBI Accession No. WP_051812394.1 dated Aug. 16, 2015.
NCBI Accession No. WP_052681825.1 dated Jan. 12, 2018.
NCBI Accession No. WP_101384472.1 dated Dec. 27, 2017.
NCBI Accession No. WP_104818078.1 dated Mar. 2, 2018.
UniProt Accession No. A0A327WPB0 dated Oct. 10, 2018.
Brunetti-Pierri, N. et al. (Feb. 15, 2011, e-pub. Nov. 23, 2010). "Phenylbutyrate Therapy For Maple Syrup Urine Disease," Human Molecular Genetics 20(4):631-640.
Extended European Search Report dated Jan. 25, 2024, for European Patent Application No. 21751078.3, 11 pages.
International Preliminary Report on Patentability issued on Jul. 28, 2022 for PCT Application No. PCT/US2021/0165450, filed on Feb. 3, 2021, 6 pages.
International Preliminary Report on Patentability issued on May 2, 2024 for PCT Application No. PCT/US2022/079089, filed on Nov. 1, 2022, 7 pages.
International Search Report and Written Opinion of the International Searching Authority mailed on Jun. 6, 2023 for PCT Application No. PCT/US2022/079089 filed on Nov. 1, 2022, 11 pages.
Peters, J.M. et al. (Oct. 7, 2011, e-pub. Apr. 10, 2013). "Bacterial Transcription Terminators: The RNA 3'-End Chronicles," J Mol Biol. 412(5):793-813.
Sahutoglu, A. S. (2020, e-pub. May 10, 2020). "Comparative Modelling Of A Novel Enzyme: Mus Musculus Leucine Decarboxylase," Turkish Journal of Chemistry 44(3): 817-832.
Skvorak, K. et al. (Aug. 9, 2023). "Oral Enzyme Therapy for Maple Syrup Urine Disease (MSUD) Suppressgges Plasma Leucine Levels In Intermediate MSUD Mice And Healthy Nonhuman Primates," Journal Of Inherited Metabolic Disease 46(6):1089-1103.

* cited by examiner

ENGINEERED LEUCINE DECARBOXYLASES

The present application claims priority to U.S. Prov. Appln. Ser. No. 62/970,039, filed Feb. 4, 2020, hereby incorporated by reference in its entirety for all purposes.

FIELD OF THE INVENTION

The present invention provides engineered leucine decarboxylase (LDC) polypeptides and compositions thereof, as well as polynucleotides encoding the engineered leucine decarboxylase (LDC) polypeptides. In some embodiments, the engineered LDC polypeptides are optimized to provide enhanced catalytic activity, as well as reduced sensitivity to proteolysis, and/or increased tolerance to low pH environments. In some embodiments, the engineered LDC polypeptides are optimized to provide improved storage stability. The present invention also provides methods for the use of the compositions comprising the engineered LDC polypeptides for therapeutic and industrial purposes.

REFERENCE TO A "SEQUENCE LISTING," A TABLE, OR A COMPUTER PROGRAM LISTING APPENDIX SUBMITTED AS AN ASCII TEXT FILE

The Sequence Listing written in file CX7-198US2_ST25.TXT, created on Feb. 3, 2021 with a size of 2.06 megabytes, machine format IBM-PC, MS-Windows operating system, is hereby incorporated by reference.

BACKGROUND OF THE INVENTION

Maple syrup urine disease (MSUD), also referred to as "leucineuria," branched chain alpha-leucine dehydrogenase deficiency," and "BCKD deficiency," is a rare inherited aminoacidopathy secondary to dysfunction in the branched chain keto acid dehydrogenase (BCKDH) complex that is involved in the catabolic pathway of leucine, isoleucine and valine (i.e., branched chain amino acids). It was first described in 1954 by Menkes et al. (Menkes et al., Pediatrics 14:462-467 [1954]) and named due to the distinctive, sweet odor of the urine of affected newborns. It is also characterized by poor feeding, vomiting, lethargy, abnormal movements (e.g., hyper or hypotonia), and delayed development. Without treatment, the disease can progress to encephalopathy, seizures, coma, permanent neurologic damage, and death. Later in life, developmental delays, learning problems, seizures, and motor difficulties are common. There are four common forms that are classified based on the signs and symptoms of disease. The most common and severe type is the "classic" type, which becomes apparent within two weeks after birth. The other types are intermediate MSUD, intermittent MSUD, and thiamine-responsive MSUD. In the classic form, the disease becomes apparent after the newborn has ingested milk containing protein. This results in an increase in isoleucine, leucine, and valine in the body, which becomes toxic to the brain. In the intermittent form, brain damage occurs during times of physical stress (e.g., infection, fever or not eating for a prolonged period), which leads to metabolic decompensation.

Diagnostic testing for MSUD in newborns includes blood and urine amino acid tests to determine the leucine, isoleucine, alloisoleucine, and valine concentrations in these fluids. If MSUD is identified, there will be signs of ketosis and acidosis. Upon diagnosis and during symptomatic episodes, treatment involves eating a protein-free diet and correction of the metabolic consequences associated with the elevated amino acid levels. Use of a special intravenous solution decreases the leucine level (the most toxic) and corrects energy deficits.

Current treatment involves dietary restriction of branched-chain amino acids (BCAAs). Deficient levels of BCKDH complex enzymes results in toxic accretion of BCAAs and their related metabolites in the cerebrospinal fluid, blood, and tissues. Without treatment or constant attentive care, this leads to numerous and serious side effects (e.g., neurological dysfunction, seizures, and infant death). Although some BCAA turnover via renal clearance (resulting in the typical sweet, maple syrup smell of affected patients' urine), it is not sufficient to provide relief from the accumulation of toxic amino acid levels in the body (See, Schadewalt and Wendel, Eur. J. Pediatr., 156(Suppl. 1): S62-66 [1997]; and Skvorak, J. Inherit. Metab. Dis., 32(2): 229-46 [2009]).

SUMMARY OF THE INVENTION

The present invention provides engineered leucine decarboxylase (LDC) polypeptides and compositions thereof, as well as polynucleotides encoding the engineered leucine decarboxylase (LDC) polypeptides. In some embodiments, the engineered LDC polypeptides are optimized to provide enhanced catalytic activity, as well as reduced sensitivity to proteolysis, and/or increased tolerance to low pH environments. In some embodiments, the engineered LDC polypeptides are optimized to provide improved storage stability. The present invention also provides methods for the use of the compositions comprising the engineered LDC polypeptides for therapeutic and industrial purposes.

The present invention is directed to engineered LDC polypeptides and biologically active fragments and analogs thereof having improved properties when compared to a wild-type LDC enzyme or a reference LDC polypeptide under essentially the same conditions. The invention is further directed to methods of using the engineered LDC polypeptides and biologically active fragments and analogs thereof in therapeutic and/or industrial compositions and methods of using such compositions for therapeutic and/or industrial purposes.

The present invention provides engineered leucine decarboxylase polypeptides comprising amino acid sequences having at least 85%, 86%, 87%, 88%, 89%, 90%, 91%, 92,%, 93%, 94%, 95%, 96%, 97%, 98%, 99%, or more sequence identity to at least one of SEQ ID NO: 2, 4, 6, 8, 10, 12, 14, 38, 234, 284, 484, 594, 686, 688, and/or 766, wherein the amino acid positions of said amino acid sequences are numbered with reference to the amino acid sequence of SEQ ID NO: 2, 4, 6, 8, 10, 12, 14, 38, 234, 284, 484, 594, 686, 688, and/or 766.

The present invention also provides engineered leucine decarboxylase polypeptides wherein said polypeptide sequences have at least 85%, 86%, 87%, 88%, 89%, 90%, 91%, 92%, 93%, 94%, 95%, 96%, 97%, 98%, 99%, or more sequence identity to SEQ ID NO: 2. The present invention further provides engineered leucine decarboxylase polypeptides wherein said polypeptide sequences have at least 85%, 86%, 87%, 88%, 89%, 90%, 91%, 92%, 93%, 94%, 95%, 96%, 97%, 98%, 99%, or more sequence identity to SEQ ID NO: 4. The present invention further provides engineered leucine decarboxylase polypeptides wherein said polypeptide sequences have at least 85%, 86%, 87%, 88%, 89%, 90%, 91%, 92%, 93%, 94%, 95%, 96%, 97%, 98%, 99%, or more sequence identity to SEQ ID NO: 6. The present invention further provides engineered leucine decarboxylase polypeptides wherein said polypeptide sequences have at least 85%, 86%, 87%, 88%, 89%, 90%, 91%, 92%, 93%, 94%, 95%, 96%, 97%, 98%, 99%, or more sequence identity to SEQ ID NO: 8. The present invention further provides engineered leucine decarboxylase polypeptides wherein said polypeptide sequences have at least 85%, 86%, 87%, 88%, 89%, 90%, 91%, 92%, 93%, 94%, 95%, 96%, 97%, 98%, 99%, or more sequence identity to SEQ ID NO: 10. The present invention further provides engineered leucine decarboxylase polypeptides wherein said polypeptide sequences have at least 85%, 86%, 87%, 88%, 89%, 90%, 91%, 92%, 93%, 94%, 95%, 96%, 97%, 98%, 99%, or more sequence identity to SEQ ID NO: 14.

In some further embodiments, the engineered leucine decarboxylase polypeptide sequence has at least 85%, 86%, 87%, 88%, 89%, 90%, 91%, 92%, 93%, 94%, 95%, 96%, 97%, 98%, 99%, or more sequence identity to SEQ ID NO: 12, and wherein the polypeptide sequence of said engineered leucine decarboxylase polypeptide comprises at least one substitution or substitution set at one or more amino acid positions selected from 5, 14, 14/34/38/39/102/267/275/350/357, 14/39/102/127/245/267/275/349/350, 34/38/39/102/127/275/357, 34/38/39/102/275/357, 34/38/39/127/245/349/350/357, 34/38/39/127/245/350/357, 34/39/102/127/264/275/357, 34/39/102/127/275/349/357, 34/39/102/264/275/350/357, 34/39/275/349/350/357, 38/39/102/127/264/267/350/357, 38/39/102/127/267/275/349/350/357, 38/39/102/127/349/350/357, 38/39/102/127/350, 38/39/102/127/350/357, 38/39/127/245/267/357, 38/39/127/264/275, 38/39/127/264/350/357, 38/39/127/350/357, 38/39/127/357, 38/39/245/275/357, 38/39/264/267/275/350, 38/39/264/275/357, 38/39/275, 38/39/275/350, 39, 39/102/127/264/275/357, 39/102/264/275/357, 39/102/267/275/357, 39/127/245/264/267/275/350, 39/127/245/264/275/350/357, 39/127/245/357, 39/127/267/275/350/357, 39/127/267/350/357, 39/127/357, 39/245/264/267/275/357, 39/264/267/275/350, 39/275/350/357, 48, 139, 164, 196, 255, 299, 318, 324, 339, 343, 350, 353, 357, 364, 365, 379, 381, 386, 389, 391, 393, 394, 395, 397, 398, and 405, wherein the amino acid positions are numbered with reference to SEQ ID NO: 12. In some additional embodiments, the polypeptide sequence of said engineered leucine decarboxylase polypeptide comprises at least one substitution or substitution set at one or more amino acid positions selected from 5M, 14I, 14T/34L/38V/39N/102S/267I/275S/350E/357V, 14T/39N/102S/127S/245M/267I/275S/349T/350E, 34L/38V/39N/102S/127S/275S/357V, 34L/38V/39N/102S/275S/357V, 34L/38V/39N/127S/245M/349T/350E/357V, 34L/38V/39N/127S/245M/350E/357V, 34L/39N/102S/127S/264V/275S/357V, 34L/39N/102S/127S/275S/349T/357V, 34L/39N/102S/264V/275S/350E/357V, 34L/39N/275S/349T/350E/357V, 38V/39N/102S/127S/264V/267I/350E/357V, 38V/39N/102S/127S/267I/275S/349T/350E/357V, 38V/39N/102S/127S/349T/350E/357V, 38V/39N/102S/127S/350E, 38V/39N/102S/127S/350E/357V, 38V/39N/127S/245M/267I/357V, 38V/39N/127S/264V/275S, 38V/39N/127S/264V/350E/357V, 38V/39N/127S/350E/357V, 38V/39N/127S/357V, 38V/39N/245M/275S/357V, 38V/39N/264V/267I/275S/350E, 38V/39N/264V/275S/357V, 38V/39N/275S, 38V/39N/275/350E, 39/102S/127S/264V/275S/357V, 39N/102S/264V/275S/357V, 39N/102S/267I/275S/357V, 39N/127S/245M/264V/267I/275S/350E, 39N/127S/245M/264V/275S/350E/357V, 39N/127S/245M/357V, 39N/127S/267I/275S/350E/357V, 39N/127S/267I/350E/357V, 39N/127S/357V, 39N/245M/264V/267I/275S/357V, 39N/264V/267I/275S/350E, 39N/275S/350E/357V, 39S, 48F, 139G, 164A, 164C, 196D, 196R, 255G, 255N, 255P, 299A, 299V, 318K, 324M, 324S, 324T, 339A, 339D, 343A, 343E, 350S, 353D, 353E, 353L, 353N, 353S, 353W, 357C, 357M, 364K, 364R, 365E, 379D, 379P, 381D, 381E, 386*, 389E, 389G, 389P, 389Q, 391*, 391E, 393T, 394E, 395A, 395D, 395G, 395K, 395S, 397A, 398*, 405D, 405E, 405H, and 405L, wherein the amino acid positions are numbered with reference to SEQ ID NO: 12. In some additional embodiments, the polypeptide sequence of said engineered leucine decarboxylase polypeptide comprises at least one substitution or substitution set at one or more positions selected from K5M, H14I, H14T/I34L/C38V/T39N/T102S/V267I/T275S/N350E/I357V, H14T/T39N/T102S/T127S/I245M/V267I/T275S/V349T/N350E, I34L/C38V/T39N/T102S/T127S/T275S/I357V, I34L/C38V/T39N/T102S/T275S/I357V, I34L/C38V/T39N/T127S/I245M/V349T/N350E/I357V, I34L/C38V/T39N/T127S/I245M/N350E/I357V, I34L/T39N/T102S/T127S/I264V/T275S/I357V, I34L/T39N/T102S/T127S/T275S/V349T/I357V, I34L/T39N/T102S/I264V/T275S/N350E/I357V, I34L/T39N/T275S/V349T/N350E/I357V, C38V/T39N/T102S/T127S/I264V/V267I/N350E/I357V, C38V/T39N/T102S/T127S/V267I/T275S/V349T/N350E/I357V, C38V/T39N/T102S/T127S/V349T/N350E/I357V, C38V/T39N/T102S/T127S/N350E, C38V/T39N/T102S/T127S/N350E/I357V, C38V/T39N/T127S/I245M/V267I/I357V, C38V/T39N/T127S/I264V/T275S, C38V/T39N/T127S/I264V/N350E/I357V, C38V/T39N/T127S/N350E/I357V, C38V/T39N/T127S/I357V, C38V/T39N/I245M/T275S/I357V, C38V/T39N/I264V/V267I/T275S/N350E, C38V/T39N/I264V/T275S/I357V, C38V/T39N/T275S, C38V/T39N/T275S/N350E, T39N/T102S/T127S/I264V/T275S/I357V, T39N/T102S/I264V/T275S/I357V, T39N/T102S/V267I/T275S/I357V, T39N/T127S/I245M/I264V/V267I/T275S/N350E, T39N/T127S/I245M/I264V/T275S/N350E/I357V, T39N/T127S/I245M/I357V, T39N/T127S/V267I/T275S/N350E/I357V, T39N/T127S/V267I/N350E/I357V, T39N/T127S/I357V, T39N/I245M/I264V/V267I/T275S/I357V, T39N/I264V/V267I/T275S/N350E, T39N/T275S/N350E/I357V, T39S, L48F, N139G, I164A, I164C, K196D, K196R, H255G, H255N, H255P, K299A, K299V, R318K, R324M, R324S, R324T, Q339A, Q339D, H343A, H343E, N350S, R353D, R353E, R353L, R353N, R353S, R353W, I357C, I357M, L364K, L364R, Q365E, K379D, K379P, A381D, A381E, D386*, K389E, K389G, K389P, K389Q, A391*, A391E, K393T, K394E, R395A, R395D, R395G, R395K, R395S, T397A, P398*, T405D, T405E, T405H, and T405L, wherein the amino acid positions are numbered with reference to SEQ ID NO: 12.

In some further embodiments, the engineered leucine decarboxylase polypeptide sequence has at least 85%, 86%, 87%, 88%, 89%, 90%, 91%, 92%, 93%, 94%, 95%, 96%, 97%, 98%, 99%, or more sequence identity to SEQ ID NO:38, and wherein the polypeptide sequence of said engineered leucine decarboxylase polypeptide comprises at least one substitution or substitution set at one or more amino acid positions selected from 48/64/164/324/343/353/357/364, 48/64/164/324/343/364, 48/64/164/353/357/364, 48/64/357/364, 64/164/324/343/353/357/364, 64/164/324/343/357/364, 64/164/353/357, 64/318/324/357/364, 64/324/353/357/364, 132/255/339/379/395, 164/196/324/357/364, 164/318/324/343/353/357, 164/318/324/357/364, 164/324/343/353/357/364, 164/324/357/364, 164/353/357/364, 164/364, 196/318/324/353/357/364, 318/343/357, 324/343/357/364, 324/353/357/364, 324/357/364, 339/379/389/394/395, 339/389/395, 339/391, 339/394/395/405, 357/364, 379/386, 379/

394/395/397/404/405, 379/394/395/397/405, 389/394/395/397/405, and 394/397, wherein the amino acid positions are numbered with reference to SEQ ID NO: 38. In some additional embodiments, the polypeptide sequence of said engineered leucine decarboxylase polypeptide comprises at least one substitution or substitution set at one or more amino acid positions selected from 48F/64E/164A/324M/343E/353E/357C/364K, 48F/64E/164A/324M/343E/364R, 48F/64E/164C/353N/357V/364R, 48F/64E/357M/364K, 64E/164A/324M/343E/353D/357V/364K, 64E/164A/324M/343E/357C/364R, 64E/164C/353D/357V, 64E/318K/324S/357V/364R, 64E/324M/353N/357C/364R, 132F/255P/339A/379D/395D, 164A/196D/324M/357C/364K, 164A/318K/324M/343E/353E/357C, 164A/324M/343E/353D/357C/364R, 164A/324M/357C/364K, 164A/353W/357C/364R, 164A/364R, 164C/318K/324S/357V/364R, 164C/324M/343E/353D/357V/364R, 164C/353D/357V/364K, 164C/353D/357V/364R, 164C/353W/357C/364R, 196D/318K/324M/353N/357C/364K, 318K/343E/357C, 318K/343E/357M, 324M/343E/357V/364K, 324M/357M/364R, 324N/353W/357C/364K, 339A/379D/389G/394E/395D, 339A/389G/395K, 339A/391*, 339A/394E/395K/405D, 357V/364R, 379D/386*, 379D/394E/395D/397A/404I/405H, 379D/394E/395K/397A/405D, 389G/394E/395D/397A/405D, and 394E/397A, wherein the amino acid positions are numbered with reference to SEQ ID NO: 38. In some additional embodiments, the polypeptide sequence of said engineered leucine decarboxylase polypeptide comprises at least one substitution or substitution set at one or more amino acid positions selected from L48F/A64E/I164A/R324M/H343E/R353E/I357C/L364K, L48F/A64E/I164A/R324M/H343E/L364R, L48F/A64E/I164C/R353N/I357V/L364R, L48F/A64E/I357M/L364K, A64E/I164A/R324M/H343E/R353D/I357V/L364K, A64E/I164A/R324M/H343E/I357C/L364R, A64E/I164C/R353D/I357V, A64E/R318K/R324S/I357V/L364R, A64E/R324M/R353N/I357C/L364R, Y132F/H255P/Q339A/K379D/R395D, I164A/K196D/R324M/I357C/L364K, I164A/R318K/R324M/H343E/R353E/I357C, I164A/R324M/H343E/R353D/I357C/L364R, I164A/R324M/I357C/L364K, I164A/R353W/I357C/L364R, I164A/L364R, I164C/R318K/R324S/I357V/L364R, I164C/R324M/H343E/R353D/I357V/L364R, I164C/R353D/I357V/L364K, I164C/R353D/I357V/L364R, I164C/R353W/I357C/L364R, K196D/R318K/R324M/R353N/I357C/L364K, R318K/H343E/I357C, R318K/H343E/I357M, R324M/H343E/I357V/L364K, R324M/I357M/L364R, R324N/R353W/I357C/L364K, Q339A/K379D/K389G/K394E/R395D, Q339A/K389G/R395K, Q339A/A391*, Q339A/K394E/R395K/T405D, I357V/L364R, K379D/D386*, K379D/K394E/R395D/T397A/R404I/T405H, K379D/K394E/R395K/T397A/T405D, K389G/K394E/R395D/T397A/T405D, and K394E/T397A, wherein the amino acid positions are numbered with reference to SEQ ID NO: 38.

In some further embodiments, the engineered leucine decarboxylase polypeptide sequence has at least 85%, 86%, 87%, 88%, 89%, 90%, 91%, 92%, 93%, 94%, 95%, 96%, 97%, 98%, 99%, or more sequence identity to SEQ ID NO: 234, and wherein the polypeptide sequence of said engineered leucine decarboxylase polypeptide comprises at least one substitution or substitution set at one or more amino acid positions selected from 2, 3, 33, 48/64/255, 48/255/339, 48/255/379, 64, 64/255, 69, 161, 193, 255, 255/318/379, 259, 263, 318/339/379, 324, 324/389/394, 324/389/394/395, 324/389/394/397, 324/394, 324/394/395, 324/394/395/397, 324/395, 339, 340, 380, 382, 389, 389/394, 389/394/395, 389/394/395/397, 389/394/397, 389/395, 389/397, 390, 394, 394/395, 394/395/397, 395, 395/397, 397, 401, and 405, wherein the amino acid positions are numbered with reference to SEQ ID NO: 234. In some additional embodiments, the polypeptide sequence of said engineered leucine decarboxylase polypeptide comprises at least one substitution or substitution set at one or more amino acid positions selected from 2E, 3M, 33L, 48F/64E/255P, 48F/255P/339A, 48F/255P/379D, 64E, 64E/255P, 64S, 69I, 161V, 193I, 255P, 255P/318K/379D, 259L, 263T, 263V, 318K/339A/379D, 324N, 324N/394E/395K/397A, 324N/395D, 324S/389G/394E, 324S/389G/394E/395D, 324S/389G/394E/397A, 324S/394E, 324S/394E/395K, 324S/394E/395K/397A, 324S/395K, 339A, 340T, 340V, 380E, 382S, 389G, 389G/394E, 389G/394E/395D, 389G/394E/395D/397A, 389G/394E/395K, 389G/394E/395K/397A, 389G/394E/397A, 389G/395D, 389G/395K, 389G/397A, 390*, 390A, 390E, 390S, 394E, 394E/395D, 394E/395K/397A, 395D/397A, 395K, 397A, 401*, 401Y, and 405H, wherein the amino acid positions are numbered with reference to SEQ ID NO: 234. In some additional embodiments, the polypeptide sequence of said engineered leucine decarboxylase polypeptide comprises at least one substitution or substitution set at one or more amino acid positions selected from G2E, N3M, F33L, L48F/A64E/H255P, L48F/H255P/Q339A, L48F/H255P/K379D, A64E, A64E/H255P, A64S, V69I, T161V, M193I, H255P, H255P/R318K/K379D, R259L, S263T, S263V, R318K/Q339A/K379D, M324N, M324N/K394E/R395K/T397A, M324N/R395D, M324S/K389G/K394E, M324S/K389G/K394E/R395D, M324S/K389G/K394E/T397A, M324S/K394E, M324S/K394E/R395K, M324S/K394E/R395K/T397A, M324S/R395K, Q339A, S340T, S340V, A380E, A382S, K389G, K389G/K394E, K389G/K394E/R395D, K389G/K394E/R395D/T397A, K389G/K394E/R395K, K389G/K394E/R395K/T397A, K389G/K394E/T397A, K389G/R395D, K389G/R395K, K389G/T397A, P390*, P390A, P390E, P390S, K394E, K394E/R395D, K394E/R395K/T397A, R395D/T397A, R395K, T397A, A401*, A401Y, and T405H, wherein the amino acid positions are numbered with reference to SEQ ID NO: 234.

In some further embodiments, the engineered leucine decarboxylase polypeptide sequence has at least 85%, 86%, 87%, 88%, 89%, 90%, 91%, 92%, 93%, 94%, 95%, 96%, 97%, 98%, 99%, or more sequence identity to SEQ ID NO: 284, and wherein the polypeptide sequence of said engineered leucine decarboxylase polypeptide comprises at least one substitution or substitution set at one or more amino acid positions selected from 2/64/69/324/380/382/388/389, 3/64/69/263/339/380/388, 3/64/69/389, 3/64/69/390, 3/64/379/380/390, 3/69/263/380, 3/69/324, 3/69/324/380/382/389/390, 12/135/259/263, 12/135/263/382, 12/259/263/304, 48/64/255, 64/69, 64/69/189/259/263/304, 64/69/189/259/263/304/339/340/379, 64/69/223/388, 64/69/223/388/389/390, 64/69/304/379/382, 64/69/324, 64/69/324/339/380/389/390, 64/69/339, 64/69/339/382/388/389, 64/69/339/389/390, 64/69/379/380, 64/69/380/388/390, 64/69/389, 64/69/390, 64/255/263, 64/263, 64/324/339/389/390, 69/223/263/324/382/388/390, 69/223/324/379/380/382/388/390, 69/263, 69/263/324, 69/263/339, 69/263/388, 69/263/389/390, 69/324/379/380/388, 69/324/380, 69/339/390, 69/382/390, 259/263/304, 259/263/304/339/340/379, 263/339/389/390, 263/390, and 304/340/379/380/382, wherein the amino acid positions are numbered with reference to SEQ ID NO: 284. In some additional embodiments, the polypeptide sequence of said engineered leucine decarboxylase polypeptide comprises at least one substitution or substitution set at one or more amino acid positions selected from 2E/64S/69I/324S/380E/382S/388A/389G, 3M/64S/ 69I/263T/339A/380E/388A, 3M/64S/69I/389G, 3M/64S/ 69I/390*, 3M/64S/379D/380E/390*, 3M/69I/263T/380E, 3M/69I/324S, 3M/69I/324S/380E/382S/389G/390*, 12G/ 135V/259K/263T, 12G/135V/263T/382G, 12G/259K/263T/ 304R, 48L/64A/255H, 64A/255H/263T, 64S/69I, 64S/69I/ 189A/259Q/263T/304R/339A/340T/379N, 64S/69I/189D/ 259K/263T/304R, 64S/69I/223M/388A, 64S/69I/223M/ 388A/389G/390*, 64S/69I/304R/379E/382G, 64S/69I/ 324S, 64S/69I/324S/339A/380E/389G/390*, 64S/69I/ 339A, 64S/69I/339A/382S/388A/389G, 64S/69I/339A/ 389G/390*, 64S/69I/379D/380E, 64S/69I/380E/388A/ 390*, 64S/69I/389G, 64S/69I/390*, 64S/263T, 64S/324S/ 339A/389G/390*, 69I/223M/263T/324S/382S/388A/390*, 69I/223M/324S/379D/380E/382S/388A/390*, 69I/263T, 69I/263T/324S, 69I/263T/339A, 69I/263T/388A, 69I/ 263T/389G/390*, 69I/324S/379D/380E/388A, 69I/324S/ 380E, 69I/339A/390*, 69I/382S/390*, 259K/263T/304R, 259K/263T/304R/339A/340T/379N, 263T/339A/389G/ 390*, 263T/390*, and 304R/340T/379D/380E/382G, wherein the amino acid positions are numbered with reference to SEQ ID NO: 284. In some additional embodiments, the polypeptide sequence of said engineered leucine decarboxylase polypeptide comprises at least one substitution or substitution set at one or more amino acid positions selected from G2E/E64S/V69L/M324S/A380E/A382S/Q388A/ K389G, N3M/E64S/V69I/S263T/Q339A/A380E/Q388A, N3M/E64S/V69I/K389G, N3M/E64S/V69I/P390*, N3M/ E64S/K379D/A380E/P390*, N3M/V69I/S263T/A380E, N3M/V69I/M324S, N3M/V69L/M324S/A380E/A382S/ K389G/P390*, S12G/L135V/R259K/S263T, S12G/L135V/ S263T/A382G, S12G/R259K/S263T/A304R, F48L/E64A/ P255H, E64A/P255H/S263T, E64S/V69I, E64S/V69I/ T189A/R259Q/S263T/A304R/Q339A/S340T/K379N, E64S/V69I/T189D/R259K/S263T/A304R, E64S/V69I/ A223M/Q388A, E64S/V69I/A223M/Q388A/K389G/ P390*, E64S/V69I/A304R/K379E/A382G, E64S/V69I/ M324S, E64S/V69L/M324S/Q339A/A380E/K389G/ P390*, E64S/V69I/Q339A, E64S/V69I/Q339A/A382S/ Q388A/K389G, E64S/V69I/Q339A/K389G/P390*, E64S/ V69I/K379D/A380E, E64S/V69I/A380E/Q388A/P390*, E64S/V69I/K389G, E64S/V69I/P390*, E64S/S263T, E64S/ M324S/Q339A/K389G/P390*, V69I/A223M/S263T/ M324S/A382S/Q388A/P390*, V69I/A223M/M324S/ K379D/A380E/A382S/Q388A/P390*, V69I/S263T, V69I/ S263T/M324S, V69I/S263T/Q339A, V69I/S263T/Q388A, V69I/S263T/K389G/P390*, V69L/M324S/K379D/A380E/ Q388A, V69L/M324S/A380E, V69I/Q339A/P390*, V69I/ A382S/P390*, R259K/S263T/A304R, R259K/S263T/ A304R/Q339A/S340T/K379N, S263T/Q339A/K389G/ P390*, S263T/P390*, and A304R/S340T/K379D/A380E/ A382G, wherein the amino acid positions are numbered with reference to SEQ ID NO: 284.

In some further embodiments, the engineered leucine decarboxylase polypeptide sequence has at least 85%, 86%, 87%, 88%, 89%, 90%, 91%, 92%, 93%, 94%, 95%, 96%, 97%, 98%, 99%, or more sequence identity to SEQ ID NO:484, and wherein the polypeptide sequence of said engineered leucine decarboxylase polypeptide comprises at least one substitution or substitution set at one or more amino acid positions selected from 3/194/304, 3/259/263/ 304, 3/259/304, 3/259/304/324/339, 3/259/304/324/382, 3/259/304/324, 3/263/304/324, 3/263/304/324/339, 3/263/ 304/324/382, 3/304, 3/304/324, 16, 63, 77, 80, 87/270, 87/270/365, 87/328/365, 91, 92, 126, 140, 156, 168/270/ 328/338, 181, 194, 201, 256, 259, 259/263, 259/263/304, 259/263/304/324, 259/263/304/324/382, 259/263/304/379, 259/263/304/382, 259/304, 259/304/324, 259/304/324/339, 259/304/324/339/382, 259/304/382, 262, 263/304, 263/304/ 324, 263/304/324/339, 263/304/324/382, 263/324, 270, 270/ 319, 270/328/338, 270/328/338/365, 304, 304/324, 324, 328, 352, 365, 366, and 382, wherein the amino acid positions are numbered with reference to SEQ ID NO: 484. In some additional embodiments, the polypeptide sequence of said engineered leucine decarboxylase polypeptide comprises at least one substitution or substitution set at one or more amino acid positions selected from 3M/194L/304R, 3M/259K/263T/304R, 3M/259K/304R, 3M/259K/304R/ 324S/339A, 3M/259K/304R/324S/382S, 3M/259K/304R/ 382S, 3M/263T/304R/324S, 3M/263T/304R/324S/339A, 3M/263T/304R/324S/382S, 3M/304R, 3M/304R/324S, 16Q, 16V, 63C, 77L, 80G, 80K, 87R/270R, 87R/270R/ 365E, 87R/328N/365E, 91A, 91Q, 92K, 126A, 126T, 140V, 156A, 156S, 168K/270R/328N/338S, 181K, 181R, 181V, 194C, 194L, 201D, 256W, 259K, 259K/263T, 259K/263T/ 304R, 259K/263T/304R/324S, 259K/263T/304R/324S/ 382S, 259K/263T/304R/379D, 259K/263T/304R/382S, 259K/304R, 259K/304R/324S, 259K/304R/324S/339A, 259K/304R/324S/339A/382S, 259K/304R/382S, 262D, 262G, 262H, 262I, 262S, 262T, 263T/304R, 263T/304R/ 324S, 263T/304R/324S/339A, 263T/304R/324S/382S, 263T/324S, 270R, 270R/319A, 270R/328N/338S, 270R/ 328N/338S/365E, 304R, 304R/324S, 324S, 328N, 352A, 365E, 366A, 366L, 366M, 366Q, 366T, 366V, and 382S, wherein the amino acid positions are numbered with reference to SEQ ID NO: 484. In some additional embodiments, the polypeptide sequence of said engineered leucine decarboxylase polypeptide comprises at least one substitution or substitution set at one or more amino acid positions selected from N3M/F194L/A304R, N3M/R259K/S263T/A304R, N3M/R259K/A304R, N3M/R259K/A304R/M324S/ Q339A, N3M/R259K/A304R/M324S/A382S, N3M/ R259K/A304R/A382S, N3M/S263T/A304R/M324S, N3M/ S263T/A304R/M324S/Q339A, N3M/S263T/A304R/ M324S/A382S, N3M/A304R, N3M/A304R/M324S, R16Q, R16V, A63C, E77L, A80G, A80K, H87R/L270R, H87R/ L270R/Q365E, H87R/C328N/Q365E, E91A, E91Q, E92K, D126A, D126T, M140V, G156A, G156S, C168K/L270R/ C328N/P338S, T181K, T181R, T181V, F194C, F194L, E201D, Y256W, R259K, R259K/S263T, R259K/S263T/ A304R, R259K/S263T/A304R/M324S, R259K/S263T/ A304R/M324S/A382S, R259K/S263T/A304R/K379D, R259K/S263T/A304R/A382S, R259K/A304R, R259K/ A304R/M324S, R259K/A304R/M324S/Q339A, R259K/ A304R/M324S/Q339A/A382S, R259K/A304R/A382S, R262D, R262G, R262H, R262I, R262S, R262T, S263T/ A304R, S263T/A304R/M324S, S263T/A304R/M324S/ Q339A, S263T/A304R/M324S/A382S, S263T/M324S, L270R, L270R/I319A, L270R/C328N/P338S, L270R/ C328N/P338S/Q365E, A304R, A304R/M324S, M324S, C328N, D352A, Q365E, H366A, H366L, H366M, H366Q, H366T, H366V, and A382S, wherein the amino acid positions are numbered with reference to SEQ ID NO: 484.

In some further embodiments, the engineered leucine decarboxylase polypeptide sequence has at least 85%, 86%, 87%, 88%, 89%, 90%, 91%, 92%, 93%, 94%, 95%, 96%, 97%, 98%, 99%, or more sequence identity to SEQ ID NO: 594, and wherein the polypeptide sequence of said engineered leucine decarboxylase polypeptide comprises at least one substitution or substitution set at one or more amino acid positions selected from 16/63/80/126/168/366, 16/63/80/ 126/181/194/259/324/328/366, 16/63/126/168/270/328/ 366, 16/80/126/324/366, 16/80/126/366, 16/80/168, 16/80/ 168/270/366, 16/80/168/324, 16/80/168/366, 16/80/324, 16/91/126/168/324/366, 16/126/168/366, 16/168/259/366, 16/168/270/324/366, 16/168/324/328/366, 16/168/324/366, 16/168/366, 16/259/263/328, 16/324/328/366, 16/328/366, 80/126/168/270/366, 80/126/168/366, 80/126/181/270/324/366, 80/168/270/366, and 168/366, wherein the amino acid positions are numbered with reference to SEQ ID NO: 594. In some additional embodiments, the polypeptide sequence of said engineered leucine decarboxylase polypeptide comprises at least one substitution or substitution set at one or more amino acid positions selected from 16Q/63C/80K/126T/168K/366M, 16Q/63C/80K/126T/181R/194C/259K/324S/328N/366M, 16Q/63C/126T/168K/270R/328N/366M, 16Q/80K/126T/324S/366M, 16Q/80K/126T/366M, 16Q/80K/168K, 16Q/80K/168K/270R/366M, 16Q/80K/168K/324S, 16Q/80K/168K/366M, 16Q/80K/324S, 16Q/91A/126T/168K/324S/366M, 16Q/126T/168K/366M, 16Q/168K/259K/366M, 16Q/168K/270R/324S/366M, 16Q/168K/324S/328N/366M, 16Q/168K/324S/366M, 16Q/168K/366M, 16Q/259K/263T/328N, 16Q/324S/328N/366M, 16Q/328N/366M, 80K/126T/168K/270R/366M, 80K/126T/168K/366M, 80K/126T/181K/270R/324S/366M, 80K/168K/270R/366M, and 168K/366M, wherein the amino acid positions are numbered with reference to SEQ ID NO: 594. In some additional embodiments, the polypeptide sequence of said engineered leucine decarboxylase polypeptide comprises at least one substitution or substitution set at one or more amino acid positions selected from R16Q/A63C/A80K/D126T/C168K/H366M, R16Q/A63C/A80K/D126T/T181R/F194C/R259K/M324S/C328N/H366M, R16Q/A63C/D126T/C168K/L270R/C328N/H366M, R16Q/A80K/D126T/M324S/H366M, R16Q/A80K/D126T/H366M, R16Q/A80K/C168K, R16Q/A80K/C168K/L270R/H366M, R16Q/A80K/C168K/M324S, R16Q/A80K/C168K/H366M, R16Q/A80K/M324S, R16Q/E91A/D126T/C168K/M324S/H366M, R16Q/D126T/C168K/H366M, R16Q/C168K/R259K/H366M, R16Q/C168K/L270R/M324S/H366M, R16Q/C168K/M324S/C328N/H366M, R16Q/C168K/M324S/H366M, R16Q/C168K/H366M, R16Q/R259K/S263T/C328N, R16Q/M324S/C328N/H366M, R16Q/C328N/H366M, A80K/D126T/C168K/L270R/H366M, A80K/D126T/C168K/H366M, A80K/D126T/T181R/L270R/M324S/H366M, A80K/C168K/L270R/H366M, and C168K/H366M, wherein the amino acid positions are numbered with reference to SEQ ID NO: 594.

In some further embodiments, the engineered leucine decarboxylase polypeptide sequence has at least 85%, 86%, 87%, 88%, 89%, 90%, 91%, 92%, 93%, 94%, 95%, 96%, 97%, 98%, 99%, or more sequence identity to SEQ ID NO:686, and wherein the polypeptide sequence of said engineered leucine decarboxylase polypeptide comprises at least one substitution or substitution set at one or more amino acid positions selected from 66/76/118/141/201/300, 66/76/198/200/296/303, 66/76/198/200/300, 66/118/200/296/303/317, 66/118/296, 66/118/296/300, 66/200, 76/118/141/200/296, 76/141/198/200/201/300, 80/201/270, 80/270, 80/270/324, 89/118/200, 106/270/324/352, 118/141/200, 126, 126/201/270/324, 126/270, 141/144/198/200/300, 156/270, 156/270/324, 201/270, 201/270/352, 270, and 270/324, wherein the amino acid positions are numbered with reference to SEQ ID NO: 686. In some additional embodiments, the polypeptide sequence of said engineered leucine decarboxylase polypeptide comprises at least one substitution or substitution set at one or more amino acid positions selected from 66N/76V/118D/141P/201R/300K, 66N/76V/198G/200S/296E/303Q, 66N/76V/198G/200S/300K, 66N/118D/200S/296E/303Q/317Q, 66N/118D/296E, 66N/118D/296E/300K, 66N/200S, 76V/118D/141P/200S/296E, 76V/141P/198G/200S/201R/300K, 80K/201D/270R, 80K/270R, 80K/270R/324S, 89P/118D/200S, 106M/270R/324S/352A, 118D/141P/200S, 126T, 126T/201D/270R/324S, 126T/270R, 141P/144V/198G/200S/300K, 156A/270R, 156A/270R/324S, 201D/270R, 201D/270R/352A, 270R, and 270R/324S, wherein the amino acid positions are numbered with reference to SEQ ID NO: 686. In some additional embodiments, the polypeptide sequence of said engineered leucine decarboxylase polypeptide comprises at least one substitution or substitution set at one or more amino acid positions selected from S66N/R76V/T118D/R141P/E201R/R300K, S66N/R76V/A198G/H200S/D296E/A303Q, S66N/R76V/A198G/H200S/R300K, S66N/T118D/H200S/D296E/A303Q/K317Q, S66N/T118D/D296E, S66N/T118D/D296E/R300K, S66N/H200S, R76V/T118D/R141P/H200S/D296E, R76V/R141P/A198G/H200S/E201R/R300K, A80K/E201D/L270R, A80K/L270R, A80K/L270R/M324S, A89P/T118D/H200S, L106M/L270R/M324S/D352A, T118D/R141P/H200S, D126T, D126T/E201D/L270R/M324S, D126T/L270R, R141P/M144V/A198G/H200S/R300K, G156A/L270R, G156A/L270R/M324S, E201D/L270R, E201D/L270R/D352A, L270R, and L270R/M324S, wherein the amino acid positions are numbered with reference to SEQ ID NO: 686.

In some further embodiments, the engineered leucine decarboxylase polypeptide sequence has at least 85%, 86%, 87%, 88%, 89%, 90%, 91%, 92%, 93%, 94%, 95%, 96%, 97%, 98%, 99%, or more sequence identity to SEQ ID NO:686, and wherein the polypeptide sequence of said engineered leucine decarboxylase polypeptide comprises at least one substitution or substitution set at one or more amino acid positions selected from 19, 109, 123, 134, 170, 173, 187, 211, and 312, wherein the amino acid positions are numbered with reference to SEQ ID NO: 686. In some additional embodiments, the polypeptide sequence of said engineered leucine decarboxylase polypeptide comprises at least one substitution or substitution set at one or more amino acid positions selected from 19I, 109G, 123F, 123M, 123V, 134A, 134S, 170A, 173A, 173I, 173T, 187L, 211S, and 312A, wherein the amino acid positions are numbered with reference to SEQ ID NO: 686. In some additional embodiments, the polypeptide sequence of said engineered leucine decarboxylase polypeptide comprises at least one substitution or substitution set at one or more amino acid positions selected from L19I, L109G, Y123F, Y123M, Y123V, N134A, N134S, P170A, F173A, F173I, F173T, V187L, A211S, and T312A, wherein the amino acid positions are numbered with reference to SEQ ID NO: 686.

In some additional embodiments, the polypeptide sequence of said engineered leucine decarboxylase polypeptide comprises at least one substitution or substitution set at one or more amino acid positions selected from 5, 14, 14/34/38/39/102/267/275/350/357, 14/39/102/127/245/267/275/349/350, 34/38/39/102/127/275/357, 34/38/39/102/275/357, 34/38/39/127/245/349/350/357, 34/38/39/127/245/350/357, 34/39/102/127/264/275/357, 34/39/102/127/275/349/357, 34/39/102/264/275/350/357, 34/39/275/349/350/357, 38/39/102/127/264/267/350/357, 38/39/102/127/267/275/349/350/357, 38/39/102/127/349/350/357, 38/39/102/127/350, 38/39/102/127/350/357, 38/39/127/245/267/357, 38/39/127/264/275, 38/39/127/264/350/357, 38/39/127/350/357, 38/39/127/357, 38/39/245/275/357, 38/39/264/267/275/350, 38/39/264/275/357, 38/39/275, 38/39/275/350, 39, 39/102/127/264/275/357, 39/102/264/275/357, 39/102/267/275/357, 39/127/245/264/267/275/350, 39/127/245/264/275/350/357, 39/127/245/357, 39/127/267/275/

350/357, 39/127/267/350/357, 39/127/357, 39/245/264/267/ 275/357, 39/264/267/275/350, 39/275/350/357, 48, 139, 164, 196, 255, 299, 318, 324, 339, 343, 350, 353, 357, 364, 365, 379, 381, 386, 389, 391, 393, 394, 395, 397, 398, and 405, wherein the amino acid positions are numbered with reference to SEQ ID NO: 12. In some additional embodiments, the polypeptide sequence of said engineered leucine decarboxylase polypeptide comprises at least one substitution or substitution set at one or more amino acid positions selected from 5M, 14I, 14T/34L/38V/39N/102S/267I/275S/ 350E/357V, 14T/39N/102S/127S/245M/267I/275S/349T/ 350E, 34L/38V/39N/102S/127S/275S/357V, 34L/38V/39N/ 102S/275S/357V, 34L/38V/39N/127S/245M/349T/350E/ 357V, 34L/38V/39N/127S/245M/350E/357V, 34L/39N/ 102S/127S/264V/275S/357V, 34L/39N/102S/127S/275S/ 349T/357V, 34L/39N/102S/264V/275S/350E/357V, 34L/ 39N/275S/349T/350E/357V, 38V/39N/102S/127S/264V/ 267I/350E/357V, 38V/39N/102S/127S/267I/275S/349T/ 350E/357V, 38V/39N/102S/127S/349T/350E/357V, 38V/ 39N/102S/127S/350E, 38V/39N/102S/127S/350E/357V, 38V/39N/127S/245M/267I/357V, 38V/39N/127S/264V/ 275S, 38V/39N/127S/264V/350E/357V, 38V/39N/127S/ 350E/357V, 38V/39N/127S/357V, 38V/39N/245M/275S/ 357V, 38V/39N/264V/267I/275S/350E, 38V/39N/264V/ 275S/357V, 38V/39N/275S, 38V/39N/275S/350E, 39N/ 102S/127S/264V/275S/357V, 39N/102S/264V/275S/357V, 39N/102S/267I/275S/357V, 39N/127S/245M/264V/267I/ 275S/350E, 39N/127S/245M/264V/275S/350E/357V, 39N/ 127S/245M/357V, 39N/127S/267I/275S/350E/357V, 39N/ 127S/267I/350E/357V, 39N/127S/357V, 39N/245M/264V/ 267I/275S/357V, 39N/264V/267I/275S/350E, 39N/275S/ 350E/357V, 39S, 48F, 139G, 164A, 164C, 196D, 196R, 255G, 255N, 255P, 299A, 299V, 318K, 324M, 324S, 324T, 339A, 339D, 343A, 343E, 350S, 353D, 353E, 353L, 353N, 353S, 353W, 357C, 357M, 364K, 364R, 365E, 379D, 379P, 381D, 381E, 386*, 389E, 389G, 389P, 389Q, 391*, 391E, 393T, 394E, 395A, 395D, 395G, 395K, 395S, 397A, 398*, 405D, 405E, 405H, and 405L, wherein the amino acid positions are numbered with reference to SEQ ID NO: 12. In some additional embodiments, the polypeptide sequence of said engineered leucine decarboxylase polypeptide comprises at least one substitution or substitution set at one or more amino acid positions selected from K5M, H14I, H14T/ I34L/C38V/T39N/T102S/V267I/T275S/N350E/I357V, H14T/T39N/T102S/T127S/I245M/V267I/T275S/V349T/ N350E, I34L/C38V/T39N/T102S/T127S/T275S/I357V, I34L/C38V/T39N/T102S/T275S/I357V, I34L/C38V/ T39N/T127S/I245M/V349T/N350E/I357V, I34L/C38V/ T39N/T127S/I245M/N350E/I357V, I34L/T39N/T102S/ T127S/I264V/T275S/I357V, I34L/T39N/T102S/T127S/ T275S/V349T/I357V, I34L/T39N/T102S/I264V/T275S/ N350E/I357V, I34L/T39N/T275S/V349T/N350E/I357V, C38V/T39N/T102S/T127S/I264V/V267I/N350E/I357V, C38V/T39N/T102S/T127S/V267I/T275S/V349T/N350E/ I357V, C38V/T39N/T102S/T127S/V349T/N350E/I357V, C38V/T39N/T102S/T127S/N350E, C38V/T39N/T102S/ T127S/N350E/I357V, C38V/T39N/T127S/I245M/V267I/ I357V, C38V/T39N/T127S/I264V/T275S, C38V/T39N/ T127S/I264V/N350E/I357V, C38V/T39N/T127S/N350E/ I357V, C38V/T39N/T127S/I357V, C38V/T39N/I245M/ T275S/I357V, C38V/T39N/I264V/V267I/T275S/N350E, C38V/T39N/I264V/T275S/I357V, C38V/T39N/T275S, C38V/T39N/T275S/N350E, T39N/T102S/T127S/I264V/ T275S/I357V, T39N/T102S/I264V/T275S/I357V, T39N/ T102S/V267I/T275S/I357V, T39N/T127S/I245M/I264V/ V267I/T275S/N350E, T39N/T127S/I245M/I264V/T275S/ N350E/I357V, T39N/T127S/I245M/I357V, T39N/T127S/ V267I/T275S/N350E/I357V, T39N/T127S/V267I/N350E/ I357V, T39N/T127S/I357V, T39N/I245M/I264V/V267I/ T275S/I357V, T39N/I264V/V267I/T275S/N350E, T39N/ T275S/N350E/I357V, T39S, L48F, N139G, I164A, I164C, K196D, K196R, H255G, H255N, H255P, K299A, K299V, R318K, R324M, R324S, R324T, Q339A, Q339D, H343A, H343E, N350S, R353D, R353E, R353L, R353N, R353S, R353W, I357C, I357M, L364K, L364R, Q365E, K379D, K379P, A381D, A381E, D386*, K389E, K389G, K389P, K389Q, A391*, A391E, K393T, K394E, R395A, R395D, R395G, R395K, R395S, T397A, P398*, T405D, T405E, T405H, and T405L, wherein the amino acid positions are numbered with reference to SEQ ID NO: 12.

In some additional embodiments, the polypeptide sequence of said engineered leucine decarboxylase polypeptide comprises at least one substitution or substitution set at one or more amino acid positions selected from 48/64/164/ 324/343/353/357/364, 48/64/164/324/343/364, 48/64/164/ 353/357/364, 48/64/357/364, 64/164/324/343/353/357/364, 64/164/324/343/357/364, 64/164/353/357, 64/318/324/357/ 364, 64/324/353/357/364, 132/255/339/379/395, 164/196/ 324/357/364, 164/318/324/343/353/357, 164/318/324/357/ 364, 164/324/343/353/357/364, 164/324/357/364, 164/353/ 357/364, 164/364, 196/318/324/353/357/364, 318/343/357, 324/343/357/364, 324/353/357/364, 324/357/364, 339/379/ 389/394/395, 339/389/395, 339/391, 339/394/395/405, 357/ 364, 379/386, 379/394/395/397/404/405, 379/394/395/397/ 405, 389/394/395/397/405, and 394/397, wherein the amino acid positions are numbered with reference to SEQ ID NO: 38. In some additional embodiments, the polypeptide sequence of said engineered leucine decarboxylase polypeptide comprises at least one substitution or substitution set at one or more amino acid positions from 48F/64E/164A/ 324M/343E/353E/357C/364K, 48F/64E/164A/324M/343E/ 364R, 48F/64E/164C/353N/357V/364R, 48F/64E/357M/ 364K, 64E/164A/324M/343E/353D/357V/364K, 64E/ 164A/324M/343E/357C/364R, 64E/164C/353D/357V, 64E/ 318K/324S/357V/364R, 64E/324M/353N/357C/364R, 132F/255P/339A/379D/395D, 164A/196D/324M/357C/ 364K, 164A/318K/324M/343E/353E/357C, 164A/324M/ 343E/353D/357C/364R, 164A/324M/357C/364K, 164A/ 353W/357C/364R, 164A/364R, 164C/318K/324S/357V/ 364R, 164C/324M/343E/353D/357V/364R, 164C/353D/ 357V/364K, 164C/353D/357V/364R, 164C/353W/357C/ 364R, 196D/318K/324M/353N/357C/364K, 318K/343E/ 357C, 318K/343E/357M, 324M/343E/357V/364K, 324M/ 357M/364R, 324N/353W/357C/364K, 339A/379D/389G/ 394E/395D, 339A/389G/395K, 339A/391*, 339A/394E/ 395K/405D, 357V/364R, 379D/386*, 379D/394E/395D/ 397A/4041/405H, 379D/394E/395K/397A/405D, 389G/ 394E/395D/397A/405D, and 394E/397A, wherein the amino acid positions are numbered with reference to SEQ ID NO: 38. In some additional embodiments, the polypeptide sequence of said engineered leucine decarboxylase polypeptide comprises at least one substitution or substitution set at one or more amino acid positions from L48F/ A64E/I164A/R324M/H343E/R353E/I357C/L364K, L48F/ A64E/I164A/R324M/H343E/L364R, L48F/A64E/I164C/ R353N/I357V/L364R, L48F/A64E/I357M/L364K, A64E/ I164A/R324M/H343E/R353D/I357V/L364K, A64E/ I164A/R324M/H343E/I357C/L364R, A64E/I164C/ R353D/I357V, A64E/R318K/R324S/I357V/L364R, A64E/ R324M/R353N/I357C/L364R, Y132F/H255P/Q339A/ K379D/R395D, I164A/K196D/R324M/I357C/L364K, I164A/R318K/R324M/H343E/R353E/I357C, I164A/ R324M/H343E/R353D/I357C/L364R, I164A/R324M/ I357C/L364K, I164A/R353W/I357C/L364R, I164A/

L364R, I164C/R318K/R324S/I357V/L364R, I164C/ R324M/H343E/R353D/I357V/L364R, I164C/R353D/ I357V/L364R, I164C/R353D/I357V/L364R, I164C/ R353W/I357C/L364R, K196D/R318K/R324M/R353N/ I357C/L364K, R318K/H343E/I357C, R318K/H343E/ I357M, R324M/H343E/I357V/L364K, R324M/I357M/ L364R, R324N/R353W/I357C/L364K, Q339A/K379D/ K389G/K394E/R395D, Q339A/K389G/R395K, Q339A/ A391*, Q339A/K394E/R395K/T405D, I357V/L364R, K379D/D386*, K379D/K394E/R395D/T397A/R404L/ T405H, K379D/K394E/R395K/T397A/T405D, K389G/ K394E/R395D/T397A/T405D, and K394E/T397A, wherein the amino acid positions are numbered with reference to SEQ ID NO: 38.

In some additional embodiments, the polypeptide sequence of said engineered leucine decarboxylase polypeptide comprises at least one substitution or substitution set at one or more amino acid positions selected from 2, 3, 33, 48/64/255, 48/255/339, 48/255/379, 64, 64/255, 69, 161, 193, 255, 255/318/379, 259, 263, 318/339/379, 324, 324/ 389/394, 324/389/394/395, 324/389/394/397, 324/394, 324/ 394/395, 324/394/395/397, 324/395, 339, 340, 380, 382, 389, 389/394, 389/394/395, 389/394/395/397, 389/394/397, 389/395, 389/397, 390, 394, 394/395, 394/395/397, 395, 395/397, 397, 401, and 405, wherein the amino acid positions are numbered with reference to SEQ ID NO: 234. In some additional embodiments, the polypeptide sequence of said engineered leucine decarboxylase polypeptide comprises at least one substitution or substitution set at one or more amino acid positions selected from 2E, 3M, 33L, 48F/64E/255P, 48F/255P/339A, 48F/255P/379D, 64E, 64E/ 255P, 64S, 69I, 161V, 193I, 255P, 255P/318K/379D, 259L, 263T, 263V, 318K/339A/379D, 324N, 324N/394E/395K/ 397A, 324N/395D, 324S/389G/394E, 324S/389G/394E/ 395D, 324S/389G/394E/397A, 324S/394E, 324S/394E/ 395K, 324S/394E/395K/397A, 324S/395K, 339A, 340T, 340V, 380E, 382S, 389G, 389G/394E, 389G/394E/395D, 389G/394E/395D/397A, 389G/394E/395K, 389G/394E/ 395K/397A, 389G/394E/397A, 389G/395D, 389G/395K, 389G/397A, 390*, 390A, 390E, 390S, 394E, 394E/395D, 394E/395K/397A, 395D/397A, 395K, 397A, 401*, 401Y, and 405H, wherein the amino acid positions are numbered with reference to SEQ ID NO: 234. In some additional embodiments, the polypeptide sequence of said engineered leucine decarboxylase polypeptide comprises at least one substitution or substitution set at one or more amino acid positions selected from G2E, N3M, F33L, L48F/A64E/ H255P, L48F/H255P/Q339A, L48F/H255P/K379D, A64E, A64E/H255P, A64S, V69I, T161V, M193I, H255P, H255P/ R318K/K379D, R259L, S263T, S263V, R318K/Q339A/ K379D, M324N, M324N/K394E/R395K/T397A, M324N/ R395D, M324S/K389G/K394E, M324S/K389G/K394E/ R395D, M324S/K389G/K394E/T397A, M324S/K394E, M324S/K394E/R395K, M324S/K394E/R395K/T397A, M324S/R395K, Q339A, S340T, S340V, A380E, A382S, K389G, K389G/K394E, K389G/K394E/R395D, K389G/ K394E/R395D/T397A, K389G/K394E/R395K, K389G/ K394E/R395K/T397A, K389G/K394E/T397A, K389G/ R395D, K389G/R395K, K389G/T397A, P390*, P390A, P390E, P390S, K394E, K394E/R395D, K394E/R395K/ T397A, R395D/T397A, R395K, T397A, A401*, A401Y, and T405H, wherein the amino acid positions are numbered with reference to SEQ ID NO: 234.

In some additional embodiments, the polypeptide sequence of said engineered leucine decarboxylase polypeptide comprises at least one substitution or substitution set at one or more amino acid positions selected from 2/64/69/ 324/380/382/388/389, 3/64/69/263/339/380/388, 3/64/69/ 389, 3/64/69/390, 3/64/379/380/390, 3/69/263/380, 3/69/ 324, 3/69/324/380/382/389/390, 12/135/259/263, 12/135/ 263/382, 12/259/263/304, 48/64/255, 64/69, 64/69/189/259/ 263/304, 64/69/189/259/263/304/339/340/379, 64/69/223/ 388, 64/69/223/388/389/390, 64/69/304/379/382, 64/69/ 324, 64/69/324/339/380/389/390, 64/69/339, 64/69/339/ 382/388/389, 64/69/339/389/390, 64/69/379/380, 64/69/ 380/388/390, 64/69/389, 64/69/390, 64/255/263, 64/263, 64/324/339/389/390, 69/223/263/324/382/388/390, 69/223/ 324/379/380/382/388/390, 69/263, 69/263/324, 69/263/339, 69/263/388, 69/263/389/390, 69/324/379/380/388, 69/324/ 380, 69/339/390, 69/382/390, 259/263/304, 259/263/304/ 339/340/379, 263/339/389/390, 263/390, and 304/340/379/ 380/382, wherein the amino acid positions are numbered with reference to SEQ ID NO: 284. In some additional embodiments, the polypeptide sequence of said engineered leucine decarboxylase polypeptide comprises at least one substitution or substitution set at one or more amino acid positions selected from 2E/64S/69I/324S/380E/382S/388A/ 389G, 3M/64S/69I/263T/339A/380E/388A, 3M/64S/69I/ 389G, 3M/64S/69I/390*, 3M/64S/379D/380E/390*, 3M/69I/263T/380E, 3M/69I/324S, 3M/691/324S/380E/ 382S/389G/390*, 12G/135V/259K/263T, 12G/135V/263T/ 382G, 12G/259K/263T/304R, 48L/64A/255H, 64A/255H/ 263T, 64S/69I, 64S/69I/189A/259Q/263T/304R/339A/ 340T/379N, 64S/69I/189D/259K/263T/304R, 64S/69I/ 223M/388A, 64S/69I/223M/388A/389G/390*, 64S/69I/ 304R/379E/382G, 64S/69I/324S, 64S/69I/324S/339A/ 380E/389G/390*, 64S/69I/339A, 64S/69I/339A/382S/ 388A/389G, 64S/69I/339A/389G/390*, 64S/69I/379D/ 380E, 64S/69I/380E/388A/390*, 64S/69I/389G, 64S/69I/ 390*, 64S/263T, 64S/324S/339A/389G/390*, 69I/223M/ 263T/324S/382S/388A/390*, 69I/223M/324S/379D/380E/ 382S/388A/390*, 69I/263T, 69I/263T/324S, 69I/263T/ 339A, 69I/263T/388A, 69I/263T/389G/390*, 69I/324S/ 379D/380E/388A, 69I/324S/380E, 69I/339A/390*, 69I/ 382S/390*, 259K/263T/304R, 259K/263T/304R/339A/ 340T/379N, 263T/339A/389G/390*, 263T/390*, and 304R/ 340T/379D/380E/382G, wherein the amino acid positions are numbered with reference to SEQ ID NO: 284. In some additional embodiments, the polypeptide sequence of said engineered leucine decarboxylase polypeptide comprises at least one substitution or substitution set at one or more amino acid positions selected from G2E/E64S/V69I/ M324S/A380E/A382S/Q388A/K389G, N3M/E64S/V69I/ S263T/Q339A/A380E/Q388A, N3M/E64S/V69I/K389G, N3M/E64S/V69I/P390*, N3M/E64S/K379D/A380E/ P390*, N3M/V69I/S263T/A380E, N3M/V69I/M324S, N3M/V69I/M324S/A380E/A382S/K389G/P390*, S12G/ L135V/R259K/S263T, S12G/L135V/S263T/A382G, S12G/ R259K/S263T/A304R, F48L/E64A/P255H, E64A/P255H/ S263T, E64S/V69I, E64S/V69L/T189A/R259Q/S263T/ A304R/Q339A/S340T/K379N, E64S/V69I/T189D/R259K/ S263T/A304R, E64S/V69I/A223M/Q388A, E64S/V69I/ A223M/Q388A/K389G/P390*, E64S/V69I/A304R/K379E/ A382G, E64S/V69I/M324S, E64S/V69L/M324S/Q339A/ A380E/K389G/P390*, E64S/V69I/Q339A, E64S/V69I/ Q339A/A382S/Q388A/K389G, E64S/V69I/Q339A/ K389G/P390*, E64S/V69I/K379D/A380E, E64S/V69I/ A380E/Q388A/P390*, E64S/V69I/K389G, E64S/V69I/ P390*, E64S/S263T, E64S/M324S/Q339A/K389G/P390*, V69I/A223M/S263T/M324S/A382S/Q388A/P390*, V69I/ A223M/M324S/K379D/A380E/A382S/Q388A/P390*, V69I/S263T, V69I/S263T/M324S, V69L/S263T/Q339A, V69I/S263T/Q388A, V69L/S263T/K389G/P390*, V69L/ M324S/K379D/A380E/Q388A, V69L/M324S/A380E, V69I/Q339A/P390*, V69I/A382S/P390*, R259K/S263T/ A304R, R259K/S263T/A304R/Q339A/S340T/K379N, S263T/Q339A/K389G/P390*, S263T/P390*, and A304R/ S340T/K379D/A380E/A382G, wherein the amino acid positions are numbered with reference to SEQ ID NO: 284. In some additional embodiments, the polypeptide sequence of said engineered leucine decarboxylase polypeptide comprises at least one substitution or substitution set at one or more amino acid positions selected from 3/194/304, 3/259/263/304, 3/259/304, 3/259/304/324/339, 3/259/304/ 324/382, 3/259/304/382, 3/263/304/324, 3/263/304/324/ 339, 3/263/304/324/382, 3/304, 3/304/324, 16, 63, 77, 80, 87/270, 87/270/365, 87/328/365, 91, 92, 126, 140, 156, 168/270/328/338, 181, 194, 201, 256, 259, 259/263, 259/ 263/304, 259/263/304/324, 259/263/304/324/382, 259/263/ 304/379, 259/263/304/382, 259/304, 259/304/324, 259/304/ 324/339, 259/304/324/339/382, 259/304/382, 262, 263/304, 263/304/324, 263/304/324/339, 263/304/324/382, 263/324, 270, 270/319, 270/328/338, 270/328/338/365, 304, 304/324, 324, 328, 352, 365, 366, and 382, wherein the amino acid positions are numbered with reference to SEQ ID NO: 484. In some additional embodiments, the polypeptide sequence of said engineered leucine decarboxylase polypeptide comprises at least one substitution or substitution set at one or more amino acid positions selected from 3M/194L/304R, 3M/259K/263T/304R, 3M/259K/304R, 3M/259K/304R/ 324S/339A, 3M/259K/304R/324S/382S, 3M/259K/304R/ 382S, 3M/263T/304R/324S, 3M/263T/304R/324S/339A, 3M/263T/304R/324S/382S, 3M/304R, 3M/304R/324S, 16Q, 16V, 63C, 77L, 80G, 80K, 87R/270R, 87R/270R/ 365E, 87R/328N/365E, 91A, 91Q, 92K, 126A, 126T, 140V, 156A, 156S, 168K/270R/328N/338S, 181K, 181R, 181V, 194C, 194L, 201D, 256W, 259K, 259K/263T, 259K/263T/ 304R, 259K/263T/304R/324S, 259K/263T/304R/324S/ 382S, 259K/263T/304R/379D, 259K/263T/304R/382S, 259K/304R, 259K/304R/324S, 259K/304R/324S/339A, 259K/304R/324S/339A/382S, 259K/304R/382S, 262D, 262G, 262H, 262I, 262S, 262T, 263T/304R, 263T/304R/ 324S, 263T/304R/324S/339A, 263T/304R/324S/382S, 263T/324S, 270R, 270R/319A, 270R/328N/338S, 270R/ 328N/338S/365E, 304R, 304R/324S, 324S, 328N, 352A, 365E, 366A, 366L, 366M, 366Q, 366T, 366V, and 382S, wherein the amino acid positions are numbered with reference to SEQ ID NO: 484. In some additional embodiments, the polypeptide sequence of said engineered leucine decarboxylase polypeptide comprises at least one substitution or substitution set at one or more amino acid positions selected from N3M/F194L/A304R, N3M/R259K/S263T/A304R, N3M/R259K/A304R, N3M/R259K/A304R/M324S/ Q339A, N3M/R259K/A304R/M324S/A382S, N3M/ R259K/A304R/A382S, N3M/S263T/A304R/M324S, N3M/ S263T/A304R/M324S/Q339A, N3M/S263T/A304R/ M324S/A382S, N3M/A304R, N3M/A304R/M324S, R16Q, R16V, A63C, E77L, A80G, A80K, H87R/L270R, H87R/ L270R/Q365E, H87R/C328N/Q365E, E91A, E91Q, E92K, D126A, D126T, M140V, G156A, G156S, C168K/L270R/ C328N/P338S, T181K, T181R, T181V, F194C, F194L, E201D, Y256W, R259K, R259K/S263T, R259K/S263T/ A304R, R259K/S263T/A304R/M324S, R259K/S263T/ A304R/M324S/A382S, R259K/S263T/A304R/K379D, R259K/S263T/A304R/A382S, R259K/A304R, R259K/ A304R/M324S, R259K/A304R/M324S/Q339A, R259K/ A304R/M324S/Q339A/A382S, R259K/A304R/A382S, R262D, R262G, R262H, R262I, R262S, R262T, S263T/ A304R, S263T/A304R/M324S, S263T/A304R/M324S/ Q339A, S263T/A304R/M324S/A382S, S263T/M324S, L270R, L270R/I319A, L270R/C328N/P338S, L270R/ C328N/P338S/Q365E, A304R, A304R/M324S, M324S, C328N, D352A, Q365E, H366A, H366L, H366M, H366Q, H366T, H366V, and A382S, wherein the amino acid positions are numbered with reference to SEQ ID NO: 484.

In some additional embodiments, the polypeptide sequence of said engineered leucine decarboxylase polypeptide comprises at least one substitution or substitution set at one or more amino acid positions selected from 16/63/80/ 126/168/366, 16/63/80/126/181/194/259/324/328/366, 16/63/126/168/270/328/366, 16/80/126/324/366, 16/80/ 126/366, 16/80/168, 16/80/168/270/366, 16/80/168/324, 16/80/168/366, 16/80/324, 16/91/126/168/324/366, 16/126/ 168/366, 16/168/259/366, 16/168/270/324/366, 16/168/324/ 328/366, 16/168/324/366, 16/168/366, 16/259/263/328, 16/324/328/366, 16/328/366, 80/126/168/270/366, 80/126/ 168/366, 80/126/181/270/324/366, 80/168/270/366, and 168/366, wherein the amino acid positions are numbered with reference to SEQ ID NO: 594. In some additional embodiments, the polypeptide sequence of said engineered leucine decarboxylase polypeptide comprises at least one substitution or substitution set at one or more amino acid positions selected from 16Q/63C/80K/126T/168K/366M, 16Q/63C/80K/126T/181R/194C/259K/324S/328N/366M, 16Q/63C/126T/168K/270R/328N/366M, 16Q/80K/126T/ 324S/366M, 16Q/80K/126T/366M, 16Q/80K/168K, 16Q/ 80K/168K/270R/366M, 16Q/80K/168K/324S, 16Q/80K/ 168K/366M, 16Q/80K/324S, 16Q/91A/126T/168K/324S/ 366M, 16Q/126T/168K/366M, 16Q/168K/259K/366M, 16Q/168K/270R/324S/366M, 16Q/168K/324S/328N/ 366M, 16Q/168K/324S/366M, 16Q/168K/366M, 16Q/ 259K/263T/328N, 16Q/324S/328N/366M, 16Q/328N/ 366M, 80K/126T/168K/270R/366M, 80K/126T/168K/ 366M, 80K/126T/181R/270R/324S/366M, 80K/168K/ 270R/366M, and 168K/366M, wherein the amino acid positions are numbered with reference to SEQ ID NO: 594. In some additional embodiments, the polypeptide sequence of said engineered leucine decarboxylase polypeptide comprises at least one substitution or substitution set at one or more amino acid positions selected from R16Q/A63C/ A80K/D126T/C168K/H366M, R16Q/A63C/A80K/D126T/ T181R/F194C/R259K/M324S/C328N/H366M, R16Q/ A63C/D126T/C168K/L270R/C328N/H366M, R16Q/ A80K/D126T/M324S/H366M, R16Q/A80K/D126T/ H366M, R16Q/A80K/C168K, R16Q/A80K/C168K/L270R/ H366M, R16Q/A80K/C168K/M324S, R16Q/A80K/ C168K/H366M, R16Q/A80K/M324S, R16Q/E91A/D126T/ C168K/M324S/H366M, R16Q/D126T/C168K/H366M, R16Q/C168K/R259K/H366M, R16Q/C168K/L270R/ M324S/H366M, R16Q/C168K/M324S/C328N/H366M, R16Q/C168K/M324S/H366M, R16Q/C168K/H366M, R16Q/R259K/S263T/C328N, R16Q/M324S/C328N/ H366M, R16Q/C328N/H366M, A80K/D126T/C168K/ L270R/H366M, A80K/D126T/C168K/H366M, A80K/ D126T/T181R/L270R/M324S/H366M, A80K/C168K/ L270R/H366M, and C168K/H366M, wherein the amino acid positions are numbered with reference to SEQ ID NO: 594.

In some additional embodiments, the polypeptide sequence of said engineered leucine decarboxylase polypeptide comprises at least one substitution or substitution set at one or more amino acid positions selected from 66/76/118/ 141/201/300, 66/76/198/200/296/303, 66/76/198/200/300, 66/118/200/296/303/317, 66/118/296, 66/118/296/300, 66/200, 76/141/198/200/201/300, 76/141/198/200/296, 80/201/270, 80/270, 80/270/324, 89/118/200, 106/270/324/ 352, 118/141/200, 126, 126/201/270/324, 126/270, 141/144/ 198/200/300, 156/270, 156/270/324, 201/270, 201/270/352, 270, and 270/324, wherein the amino acid positions are numbered with reference to SEQ ID NO: 686. In some additional embodiments, the polypeptide sequence of said engineered leucine decarboxylase polypeptide comprises at least one substitution or substitution set at one or more amino acid positions selected from 66N/76V/118D/141P/201R/300K, 66N/76V/198G/200S/296E/303Q, 66N/76V/198G/200S/300K, 66N/118D/200S/296E/303Q/317Q, 66N/118D/296E, 66N/118D/296E/300K, 66N/200S, 76V/118D/141P/200S/296E, 76V/141P/198G/200S/201R/300K, 80K/201D/270R, 80K/270R, 80K/270R/324S, 89P/118D/200S, 106M/270R/324S/352A, 118D/141P/200S, 126T, 126T/201D/270R/324S, 126T/270R, 141P/144V/198G/200S/300K, 156A/270R, 156A/270R/324S, 201D/270R, 201D/270R/352A, 270R, and 270R/324S, wherein the amino acid positions are numbered with reference to SEQ ID NO: 686. In some additional embodiments, the polypeptide sequence of said engineered leucine decarboxylase polypeptide comprises at least one substitution or substitution set at one or more amino acid positions selected from S66N/R76V/T118D/R141P/E201R/R300K, S66N/R76V/A198G/H200S/D296E/A303Q, S66N/R76V/A198G/H200S/R300K, S66N/T118D/H200S/D296E/A303Q/K317Q, S66N/T118D/D296E, S66N/T118D/D296E/R300K, S66N/H200S, R76V/T118D/R141P/H200S/D296E, R76V/R141P/A198G/H200S/E201R/R300K, A80K/E201D/L270R, A80K/L270R, A80K/L270R/M324S, A89P/T118D/H200S, L106M/L270R/M324S/D352A, T118D/R141P/H200S, D126T, D126T/E201D/L270R/M324S, D126T/L270R, R141P/M144V/A198G/H200S/R300K, G156A/L270R, G156A/L270R/M324S, E201D/L270R, E201D/L270R/D352A, L270R, and L270R/M324S, wherein the amino acid positions are numbered with reference to SEQ ID NO: 686.

In some additional embodiments, the polypeptide sequence of said engineered leucine decarboxylase polypeptide comprises at least one substitution or substitution set at one or more amino acid positions selected from 19, 109, 123, 134, 170, 173, 187, 211, and 312, wherein the amino acid positions are numbered with reference to SEQ ID NO: 686. In some additional embodiments, the polypeptide sequence of said engineered leucine decarboxylase polypeptide comprises at least one substitution or substitution set at one or more amino acid positions selected from 191, 109G, 123F, 123M, 123V, 134A, 134S, 170A, 173A, 173I, 173T, 187L, 211S, and 312A, wherein the amino acid positions are numbered with reference to SEQ ID NO: 686. In some additional embodiments, the polypeptide sequence of said engineered leucine decarboxylase polypeptide comprises at least one substitution or substitution set at one or more amino acid positions selected from L19I, L109G, Y123F, Y123M, Y123V, N134A, N134S, P170A, F173A, F173I, F173T, V187L, A211S, and T312A, wherein the amino acid positions are numbered with reference to SEQ ID NO: 686. In some additional embodiments, the polypeptide sequence of said engineered leucine decarboxylase polypeptide comprises at least one substitution or substitution set at one or more amino acid positions selected from 19/109/123/141/170/198/200/211/270/312, 19/109/123/141/170/198/211, 19/109/123/141/170/198/211/270/312, 19/109/123/170/211/270/312, 19/109/123/198/200/211/270/312, 19/109/170/173/211/270/312, 19/109/211/270/312, 109/170/211/270/312, and 109/211/270/312, wherein the amino acid positions are numbered with reference to SEQ ID NO: 688. In some additional embodiments, the polypeptide sequence of said engineered leucine decarboxylase polypeptide comprises at least one substitution or substitution set at one or more amino acid positions selected from 19/109/123F/170A/211S/270R/312A, 19/109/123F/198G/200S/211S/270R/312A, 191/109G/123V/141P/170A/198G/200S/211S/270R/312A, 19I/109G/123V/141P/170A/198G/211S, 191/109G/123V/141P/170A/198G/211S/270R/312A, 191/109G/170A/1731/211S/270R/312A, 191/109G/211S/270R/312A, 109G/170A/211S/270R/312A, and 109G/211S/270R/312A, wherein the amino acid positions are numbered with reference to SEQ ID NO: 688. In some additional embodiments, the polypeptide sequence of said engineered leucine decarboxylase polypeptide comprises at least one substitution or substitution set at one or more amino acid positions selected from L19I/L109G/Y123F/P170A/A211S/L270R/T312A, L19I/L109G/Y123F/A198G/H200S/A211S/L270R/T312A, L19I/L109G/Y123V/R141P/P170A/A198G/H200S/A211S/L270R/T312A, L19I/L109G/Y123V/R141P/P170A/A198G/A211S, L19I/L109G/Y123V/R141P/P170A/A198G/A211S/L270R/T312A, L19I/L109G/P170A/F1731/A211S/L270R/T312A, L19I/L109G/A211S/L270R/T312A, L109G/P170A/A211S/L270R/T312A, and L109G/A211S/L270R/T312A, wherein the amino acid positions are numbered with reference to SEQ ID NO: 688.

In some additional embodiments, the polypeptide sequence of said engineered leucine decarboxylase polypeptide comprises at least one substitution or substitution set at one or more amino acid positions selected from 5/41, 5/41/228, 33, 41, 47, 51, 55, 64, 126, 265, 267, 270, 331, 353, 357, and 384, wherein the amino acid positions are numbered with reference to SEQ ID NO: 766. In some additional embodiments, the polypeptide sequence of said engineered leucine decarboxylase polypeptide comprises at least one substitution or substitution set at one or more amino acid positions selected from 5V/41D, 5V/41D/228D, 33L, 41D, 47F, 51E, 51Q, 55I, 64N, 126A, 126T, 265P, 267L, 270A, 270T, 331V, 353E, 353I, 353L, 357S, and 384W, wherein the amino acid positions are numbered with reference to SEQ ID NO: 766. In some additional embodiments, the polypeptide sequence of said engineered leucine decarboxylase polypeptide comprises at least one substitution or substitution set at one or more amino acid positions selected from K5V/H41D, K5V/H41D/T228D, F33L, H41D, L47F, L51E, L51Q, V55I, S64N, D126A, D126T, E265P, I267L, R270A, R270T, T331V, D353E, D353I, D353L, C357S, and P384W, wherein the amino acid positions are numbered with reference to SEQ ID NO: 766.

In some additional embodiments, the polypeptide sequence of said engineered leucine decarboxylase polypeptide comprises at least one substitution or substitution set at one or more amino acid positions selected from 66, 66/118, 66/118/296, 66/118/296/300, 66/118/300, 66/296, 66/296/300, 66/300, 118, 118/296, 118/296/300, 118/300, 296, 296/300, and 300, wherein the amino acid positions are numbered with reference to SEQ ID NO: 766. In some additional embodiments, the polypeptide sequence of said engineered leucine decarboxylase polypeptide comprises at least one substitution or substitution set at one or more amino acid positions selected from 66S, 66S/118T, 66S/118T/296D, 66S/118T/296D/300R, 66S/118T/300R, 66S/296D, 66S/296D/300R, 66S/300R, 118T, 118T/296D, 118T/296D/300R, 118T/300R, 296D, 296D/300R, and 300R, wherein the amino acid positions are numbered with reference to SEQ ID NO: 766. In some additional embodiments, the polypeptide sequence of said engineered leucine decarboxylase polypeptide comprises at least one substitution or substitution set at one or more amino acid positions selected from N66S, N66S/D118T, N66S/D118T/E296D, N66S/D118T/E296D/K300R, N66S/D118T/K300R, N66S/

E296D, N66S/E296D/K300R, N66S/K300R, D118T, D118T/E296D, D118T/E296D/K300R, D118T/K300R, E296D, E296D/K300R, and K300R, wherein the amino acid positions are numbered with reference to SEQ ID NO: 766.

In some additional embodiments, the engineered leucine decarboxylase polypeptide comprises an amino acid sequence having at least 85%, 86%, 87%, 88%, 89%, 90%, 91%, 92%, 93%, 94%, 95%, 96%, 97%, 98%, 99%, or more sequence identity to SEQ ID NO: 2, 4, 6, 8, 10, 12, 14, 38, 234, 284, 484, 594, 686, 688, and/or 766, or a functional fragment thereof. In some additional embodiments, the engineered leucine decarboxylase polypeptide comprises an amino acid sequence having at least 90% sequence identity to SEQ ID NO: 2, 4, 6, 8, 10, 12, 14, 38, 234, 284, 484, 594, 686, 688, and/or 766, or a functional fragment thereof. In some additional embodiments, the engineered leucine decarboxylase polypeptide comprises an amino acid sequence having at least 95% sequence identity to SEQ ID NO: 2, 4, 6, 8, 10, 12, 14, 38, 234, 284, 484, 594, 686, 688, and/or 766, or a functional fragment thereof. In some embodiments, the engineered leucine decarboxylase polypeptide is a variant leucine decarboxylase polypeptide provided in any of Tables 1-2, 2-1, 3-2, 4-1, 5-1, 6-1, 7-1, 8-1, 8-2, 10-1, 11-1, and/or 11-2. In some further embodiments, the engineered leucine decarboxylase polypeptide is a Planctomycetaceae bacteria species variant enzyme. In some embodiments, the leucine decarboxylase exhibits at least one improved property as compared to wild-type Planctomycetaceae bacteria species leucine decarboxylase. In some embodiments, the engineered leucine decarboxylase polypeptide exhibits more activity on leucine than the wild-type Planctomycetaceae species leucine decarboxylase. In yet some additional embodiments, the engineered leucine decarboxylase polypeptide is more thermostable than wild-type Planctomycetaceae bacteria species leucine decarboxylase. In yet some further embodiments, the engineered leucine decarboxylase polypeptide more resistant to proteolysis than wild-type Planctomycetaceae bacteria species leucine decarboxylase. In some additional embodiments, the engineered leucine decarboxylase polypeptide is less immunogenic than wild-type Planctomycetaceae bacteria species leucine decarboxylase. In still some additional embodiments, the engineered leucine decarboxylase polypeptide is more serum stable than wild-type Planctomycetaceae bacteria species leucine decarboxylase. In some embodiments, the engineered leucine decarboxylase polypeptide comprises a sequence at least 85%, 86%, 87%, 88%, 89%, 90%, 91%, 92%, 93%, 94%, 95%, 96%, 97%, 98%, 99%, or more identical to any of the even-numbered sequences of SEQ ID NOS: 16-852. In some embodiments, the engineered leucine decarboxylase polypeptide comprises a sequence at least 90%, identical to any of the even-numbered sequences of SEQ ID NOS: 16-852. In some further embodiments, the engineered leucine decarboxylase polypeptide comprises any of the even-numbered sequences of SEQ ID NOS: 16-852. In some additional embodiments, the engineered leucine decarboxylase polypeptide is purified. The present invention also provides compositions comprising at least one engineered leucine decarboxylase polypeptide provided herein. The present invention also provides compositions comprising an engineered leucine decarboxylase polypeptide provided herein.

The present invention also provides engineered polynucleotide sequences encoding at least one engineered leucine decarboxylase polypeptide provided herein. In some embodiments, the engineered polynucleotide sequence encodes an engineered leucine decarboxylase polypeptide provided herein. In some embodiments, the engineered polynucleotide sequence comprises a sequence at least 85%, 86%, 87%, 88%, 89%, 90%, 91%, 92%, 93%, 94%, 95%, 96%, 97%, 98%, 99%, or more identical to any of the odd-numbered sequences of SEQ ID NOS: 15-851. In some additional embodiments, the engineered polynucleotide sequence comprises a sequence at least 90% or more identical to any of the odd-numbered sequences of SEQ ID NOS: 15-851. In some further embodiments, the engineered polynucleotide sequence comprises any of the odd-numbered sequences of SEQ ID NOS: 15-851. In some additional embodiments, the engineered polynucleotide sequence is operably linked to a control sequence. In some embodiments, the engineered polynucleotide sequence is codon-optimized.

The present invention also provides expression vectors comprising at least one engineered polynucleotide sequence provided herein. In some embodiments, the expression vectors further comprise at least one control sequence. In some embodiments, the control sequence comprises a promoter. In some further embodiments, the promoter is a heterologous promoter.

The present invention also provides host cells transformed with at least one polynucleotide sequence and/or comprising an expression vector provided herein. In some embodiments, the host cells are transformed with at least one polynucleotide sequence provided herein. In some embodiments, the host cells are transformed with a polynucleotide sequence provided herein. In some additional embodiments, the host cell comprise at least one expression vector provided herein. In some further embodiments, the host cells comprise an expression vector provided herein. In some embodiments, the host cell is *E. coli*.

The present invention also provides methods of producing an engineered leucine decarboxylase polypeptide in a host cell comprising culturing a host cell comprising at least one polynucleotide encoding at least one engineered leucine decarboxylase polypeptide provided herein, and/or at least one polynucleotide sequence provided herein, and/or at least one expression vector provided herein, under suitable culture conditions, such that at least one engineered leucine decarboxylase polypeptide is produced. In some embodiments, the methods of producing an engineered leucine decarboxylase polypeptide in a host cell comprise culturing a host cell comprising at least one polynucleotide encoding at least one engineered leucine decarboxylase polypeptide provided herein, under suitable culture conditions, such that at least one engineered leucine decarboxylase polypeptide is produced. In some additional embodiments, the methods of producing an engineered leucine decarboxylase polypeptide in a host cell comprising culturing a host cell comprising at least one polynucleotide sequence provided herein, under suitable culture conditions, such that at least one engineered leucine decarboxylase polypeptide is produced. In some embodiments, the methods of producing an engineered leucine decarboxylase polypeptide in a host cell comprise culturing a host cell comprising at least one expression vector provided herein, under suitable culture conditions, such that at least one engineered leucine decarboxylase polypeptide is produced. In some embodiments, the methods further comprise recovering at least one engineered leucine decarboxylase polypeptide from the culture and/or host cells. In some additional embodiments, the methods further comprise the step of purifying said at least one engineered leucine decarboxylase polypeptide.

The present invention also provides compositions comprising at least one engineered polynucleotide provided herein. In some embodiments, the compositions comprise at least one engineered leucine decarboxylase polynucleotide provided herein. In some embodiments, the compositions comprise at least one engineered polynucleotide encoding at least one engineered leucine decarboxylase polypeptide provided herein. In some embodiments, the composition is a pharmaceutical composition. In some additional embodiments, the composition further comprises at least one pharmaceutically acceptable excipient and/or carrier. In some embodiments, the composition is suitable for the treatment of maple syrup urine disease. In some additional embodiments, the composition is suitable for use in gene therapy. In still some further embodiments, the composition is suitable for use in gene therapy to treat maple syrup urine disease, and/or elevated blood levels of isoleucine, leucine, alloisoleucine and/or valine. In some additional embodiments, the composition is suitable for use in mRNA therapy. In yet some additional embodiments, the composition is suitable for oral administration to a human. In some embodiments, the composition is in the form of a pill, tablet, capsule, gelcap, liquid, or emulsion. In some further embodiments, the pill, tablet, capsule, or gelcap further comprises an enteric coating. In yet some additional embodiments, the composition is suitable for parenteral injection into an animal. In yet some additional embodiments, the composition is suitable for parenteral injection into a human. In some embodiments, the injections are administered on a daily, weekly, or monthly basis. In some additional embodiments, composition is coadministered with at least one additional therapeutically effective compound. In some embodiments, the composition comprises at least one additional therapeutically effective compound.

The present invention also provides methods for treating and/or preventing the symptoms of maple syrup urine disease in a subject, comprising providing a subject having maple syrup urine disease, and providing the composition provided herein to said subject. In some embodiments, the symptoms of maple syrup urine disease are ameliorated. In some additional embodiments, the subject is able to eat a diet that is less restricted in its in isoleucine, leucine, and/or valine content than diets required by subjects who have not been provided at least one composition comprising at least one engineered leucine decarboxylase polypeptide and/or polynucleotide provided herein. In some embodiments, the subject is able to eat a diet that is less restricted in its in isoleucine, leucine, and/or valine content than diets required by subjects who have not been provided at least one composition comprising at least one engineered leucine decarboxylase polypeptide provided herein.

In some embodiments, the subject is an infant, child, young adult, or adult. In some embodiments, the subject is an infant. In some embodiments, the subject is a child.

In some embodiments, the subject is a young adult. In some embodiments, the subject is an adult. The present invention also provides for the use of the compositions provided herein. In some embodiments, the compositions comprise at least one engineered leucine decarboxylase polypeptide and/or polynucleotide provided herein. In some embodiments, the compositions comprise at least one engineered leucine decarboxylase polypeptide provided herein. In some embodiments, the compositions comprise an engineered leucine decarboxylase polypeptide provided herein. In some embodiments, the compositions comprise at least one engineered leucine decarboxylase polynucleotide provided herein. In some embodiments, the compositions comprise an engineered leucine decarboxylase polynucleotide provided herein. In some embodiments, the compositions comprise at least one polynucleotide encoding at least one engineered leucine decarboxylase polypeptide provided herein. In some embodiments, the compositions comprise at least two polynucleotides encoding at least two engineered leucine decarboxylase polypeptides provided herein. In some embodiments, the compositions comprise at least one polynucleotide encoding at least one engineered leucine decarboxylase provided herein. In some embodiments, the compositions comprise at least one polynucleotide encoding at least two engineered leucine decarboxylases provided herein. In some embodiments, the compositions comprise a polynucleotide encoding an engineered leucine decarboxylase polypeptide provided herein.

DESCRIPTION OF THE INVENTION

The present invention provides engineered leucine decarboxylase (LDC) polypeptides and compositions thereof, as well as polynucleotides encoding the engineered leucine decarboxylase (LDC) polypeptides. In some embodiments, the engineered LDC polypeptides are optimized to provide enhanced catalytic activity, as well as reduced sensitivity to proteolysis, and/or increased tolerance to low pH environments. In some embodiments, the engineered LDC polypeptides are optimized to provide improved storage stability. The present invention also provides methods for the use of the compositions comprising the engineered LDC polypeptides for therapeutic and industrial purposes. The present invention provides engineered LDC polypeptides, mutants, biologically active fragments and analogues thereof, and pharmaceutical and industrial compositions comprising the same.

Abbreviations and Definitions:

Unless defined otherwise, all technical and scientific terms used herein generally have the same meaning as commonly understood by one of ordinary skill in the art to which this invention pertains. Generally, the nomenclature used herein and the laboratory procedures of cell culture, molecular genetics, microbiology, organic chemistry, analytical chemistry and nucleic acid chemistry described below are those well-known and commonly employed in the art. Such techniques are well-known and described in numerous texts and reference works well known to those of skill in the art. Standard techniques, or modifications thereof, are used for chemical syntheses and chemical analyses. All patents, patent applications, articles and publications mentioned herein, both supra and infra, are hereby expressly incorporated herein by reference.

Although any suitable methods and materials similar or equivalent to those described herein find use in the practice of the present invention, some methods and materials are described herein. It is to be understood that this invention is not limited to the particular methodology, protocols, and reagents described, as these may vary, depending upon the context they are used by those of skill in the art. Accordingly, the terms defined immediately below are more fully described by reference to the application as a whole. All patents, patent applications, articles and publications mentioned herein, both supra and infra, are hereby expressly incorporated herein by reference.

Also, as used herein, the singular "a", "an," and "the" include the plural references, unless the context clearly indicates otherwise.

Numeric ranges are inclusive of the numbers defining the range. Thus, every numerical range disclosed herein is intended to encompass every narrower numerical range that falls within such broader numerical range, as if such narrower numerical ranges were all expressly written herein. It is also intended that every maximum (or minimum) numerical limitation disclosed herein includes every lower (or higher) numerical limitation, as if such lower (or higher) numerical limitations were expressly written herein.

The term "about" means an acceptable error for a particular value. In some instances "about" means within 0.05%, 0.5%, 1.0%, or 2.0%, of a given value range. In some instances, "about" means within 1, 2, 3, or 4 standard deviations of a given value.

Furthermore, the headings provided herein are not limitations of the various aspects or embodiments of the invention which can be had by reference to the application as a whole. Accordingly, the terms defined immediately below are more fully defined by reference to the application as a whole. Nonetheless, in order to facilitate understanding of the invention, a number of terms are defined below.

Unless otherwise indicated, nucleic acids are written left to right in 5' to 3' orientation; amino acid sequences are written left to right in amino to carboxy orientation, respectively.

As used herein, the term "comprising" and its cognates are used in their inclusive sense (i.e., equivalent to the term "including" and its corresponding cognates).

"EC" number refers to the Enzyme Nomenclature of the Nomenclature Committee of the International Union of Biochemistry and Molecular Biology (NC-IUBMB). The IUBMB biochemical classification is a numerical classification system for enzymes based on the chemical reactions they catalyze.

"ATCC" refers to the American Type Culture Collection whose biorepository collection includes genes and strains.

"NCBI" refers to National Center for Biological Information and the sequence databases provided therein.

As used herein, the term "leucine decarboxylase (LDC) polypeptide" refers to a member of the valine decarboxylase enzyme class (EC 4.1.1.14). These enzymes use a pyridoxial 5'-phosphate (PLP) cofactor to decarboxylate amino acids such as valine and leucine, resulting in 2-methylpropanamine and isopentylamine, respectively, while releasing carbon dioxide.

"Protein," "polypeptide," and "peptide" are used interchangeably herein to denote a polymer of at least two amino acids covalently linked by an amide bond, regardless of length or post-translational modification (e.g., glycosylation or phosphorylation).

"Polynucleotide" is used herein to denote a polymer comprising at least two nucleotides where the nucleotides are either deoxyribonucleotides or ribonucleotides.

"Amino acids" are referred to herein by either their commonly known three-letter symbols or by the one-letter symbols recommended by IUPAC-IUB Biochemical Nomenclature Commission. Nucleotides, likewise, may be referred to by their commonly accepted single letter codes, as indicated The abbreviations used for the genetically encoded amino acids are conventional and are as follows: alanine (Ala or A), arginine (Arg or R), asparagine (Asn or N), aspartate (Asp or D), cysteine (Cys or C), glutamate (Glu or E), glutamine (Gln or Q), histidine (His or H), isoleucine (Ile or I), leucine (Leu or L), lysine (Lys or K), methionine (Met or M), phenylalanine (Phe or F), proline (Pro or P), serine (Ser or S), threonine (Thr or T), tryptophan (Trp or W), tyrosine (Tyr or Y), and valine (Val or V).

The term "engineered," "recombinant," "non-naturally occurring," and "variant," when used with reference to a cell, a polynucleotide or a polypeptide refers to a material or a material corresponding to the natural or native form of the material that has been modified in a manner that would not otherwise exist in nature or is identical thereto but produced or derived from synthetic materials and/or by manipulation using recombinant techniques.

As used herein, "wild-type" and "naturally-occurring" refer to the form found in nature. For example, a wild-type polypeptide or polynucleotide sequence is a sequence present in an organism that can be isolated from a source in nature and which has not been intentionally modified by human manipulation.

"Coding sequence" refers to that part of a nucleic acid (e.g., a gene) that encodes an amino acid sequence of a protein.

The term "percent (%) sequence identity" is used herein to refer to comparisons among polynucleotides and polypeptides, and are determined by comparing two optimally aligned sequences over a comparison window, wherein the portion of the polynucleotide or polypeptide sequence in the comparison window may comprise additions or deletions (i.e., gaps) as compared to the reference sequence for optimal alignment of the two sequences. The percentage may be calculated by determining the number of positions at which the identical nucleic acid base or amino acid residue occurs in both sequences to yield the number of matched positions, dividing the number of matched positions by the total number of positions in the window of comparison and multiplying the result by 100 to yield the percentage of sequence identity. Alternatively, the percentage may be calculated by determining the number of positions at which either the identical nucleic acid base or amino acid residue occurs in both sequences or a nucleic acid base or amino acid residue is aligned with a gap to yield the number of matched positions, dividing the number of matched positions by the total number of positions in the window of comparison and multiplying the result by 100 to yield the percentage of sequence identity. Those of skill in the art appreciate that there are many established algorithms available to align two sequences. Optimal alignment of sequences for comparison can be conducted (e.g., by the local homology algorithm of Smith and Waterman; Smith and Waterman, Adv. Appl. Math., 2:482 [1981]), by the homology alignment algorithm of Needleman and Wunsch (Needleman and Wunsch, J. Mol. Biol., 48:443 [1970]), by the search for similarity method of Pearson and Lipman (Pearson and Lipman, Proc. Natl. Acad. Sci. USA 85:2444 [1988]), by computerized implementations of these algorithms (e.g., GAP, BESTFIT, FASTA, and TFASTA in the GCG Wisconsin Software Package), or by visual inspection, as known in the art. Examples of algorithms that are suitable for determining percent sequence identity and sequence similarity include, but are not limited to the BLAST and BLAST 2.0 algorithms (See e.g., Altschul et al., J. Mol. Biol., 215: 403-410 [1990]; and Altschul et al., Nucleic Acids Res., 3389-3402 [1977]). Software for performing BLAST analyses is publicly available through the National Center for Biotechnology Information website. This algorithm involves first identifying high scoring sequence pairs (HSPs) by identifying short words of length "W" in the query sequence, which either match or satisfy some positive-valued threshold score "T," when aligned with a word of the same length in a database sequence. T is referred to as the neighborhood word score threshold (See, Altschul et al., supra). These initial neighborhood word hits act as seeds for initiating searches to find longer HSPs containing them. The word hits are then extended in both directions along each sequence for as far as the cumulative alignment score can be increased. Cumulative scores are calculated using, for nucleotide sequences, the parameters "M" (reward score for a pair of matching residues; always >0) and "N" (penalty score for mismatching residues; always <0). For amino acid sequences, a scoring matrix is used to calculate the cumulative score. Extension of the word hits in each direction are halted when: the cumulative alignment score falls off by the quantity "X" from its maximum achieved value; the cumulative score goes to zero or below, due to the accumulation of one or more negative-scoring residue alignments; or the end of either sequence is reached. The BLAST algorithm parameters W, T, and X determine the sensitivity and speed of the alignment. The BLASTN program (for nucleotide sequences) uses as defaults a wordlength (W) of 11, an expectation (E) of 10, M=5, N=−4, and a comparison of both strands. For amino acid sequences, the BLASTP program uses as defaults a wordlength (W) of 3, an expectation (E) of 10, and the BLOSUM62 scoring matrix (See e.g., Henikoff and Henikoff, Proc. Natl. Acad. Sci. USA 89:10915 [1989]). Exemplary determination of sequence alignment and % sequence identity can employ the BESTFIT or GAP programs in the GCG Wisconsin Software package (Accelrys, Madison WI), using default parameters provided.

"Reference sequence" refers to a defined sequence used as a basis for a sequence comparison. A reference sequence may be a subset of a larger sequence, for example, a segment of a full-length gene or polypeptide sequence. Generally, a reference sequence is at least 20 nucleotide or amino acid residues in length, at least 25 residues in length, at least 50 residues in length, at least 100 residues in length or the full length of the nucleic acid or polypeptide. Since two polynucleotides or polypeptides may each (1) comprise a sequence (i.e., a portion of the complete sequence) that is similar between the two sequences, and (2) may further comprise a sequence that is divergent between the two sequences, sequence comparisons between two (or more) polynucleotides or polypeptide are typically performed by comparing sequences of the two polynucleotides or polypeptides over a "comparison window" to identify and compare local regions of sequence similarity. In some embodiments, a "reference sequence" can be based on a primary amino acid sequence, where the reference sequence is a sequence that can have one or more changes in the primary sequence. For instance, the phrase "reference sequence based on SEQ ID NO:686 having a valine at the residue corresponding to X123" refers to a reference sequence in which the corresponding residue at position X123 in SEQ ID NO:686 (e.g., a tyrosine), has been changed to valine.

"Comparison window" refers to a conceptual segment of at least about 20 contiguous nucleotide positions or amino acids residues wherein a sequence may be compared to a reference sequence of at least 20 contiguous nucleotides or amino acids and wherein the portion of the sequence in the comparison window may comprise additions or deletions (i.e., gaps) of 20 percent or less as compared to the reference sequence (which does not comprise additions or deletions) for optimal alignment of the two sequences. The comparison window can be longer than 20 contiguous residues, and includes, optionally 30, 40, 50, 100, or longer windows.

"Corresponding to", "reference to," and "relative to" when used in the context of the numbering of a given amino acid or polynucleotide sequence refer to the numbering of the residues of a specified reference sequence when the given amino acid or polynucleotide sequence is compared to the reference sequence. In other words, the residue number or residue position of a given polymer is designated with respect to the reference sequence rather than by the actual numerical position of the residue within the given amino acid or polynucleotide sequence. For example, a given amino acid sequence, such as that of an engineered LDC, can be aligned to a reference sequence by introducing gaps to optimize residue matches between the two sequences. In these cases, although the gaps are present, the numbering of the residue in the given amino acid or polynucleotide sequence is made with respect to the reference sequence to which it has been aligned.

"Amino acid difference" and "residue difference" refer to a difference in the amino acid residue at a position of a polypeptide sequence relative to the amino acid residue at a corresponding position in a reference sequence. The positions of amino acid differences generally are referred to herein as "Xn," where n refers to the corresponding position in the reference sequence upon which the residue difference is based. For example, a "residue difference at position X123 as compared to SEQ ID NO:686" refers to a difference of the amino acid residue at the polypeptide position corresponding to position 123 of SEQ ID NO: 686. Thus, if the reference polypeptide of SEQ ID NO: 686 has a tyrosine at position 123, then a "residue difference at position X123 as compared to SEQ ID NO:686" refers to an amino acid substitution of any residue other than tyrosine at the position of the polypeptide corresponding to position 123 of SEQ ID NO:686. In most instances herein, the specific amino acid residue difference at a position is indicated as "XnY" where "Xn" specified the corresponding residue and position of the reference polypeptide (as described above), and "Y" is the single letter identifier of the amino acid found in the engineered polypeptide (i.e., the different residue than in the reference polypeptide). In some instances, the original amino acid is not indicated (e.g., 109G). In some instances (e.g., in Tables 1-2, 2-1, 3-2, 4-1, 5-1, 6-1, 7-1, 8-1, 8-2, 10-1, 11-1, and/or 11-2), the present disclosure also provides specific amino acid differences denoted by the conventional notation "AnB", where A is the single letter identifier of the residue in the reference sequence, "n" is the number of the residue position in the reference sequence, and B is the single letter identifier of the residue substitution in the sequence of the engineered polypeptide. In some instances, a polypeptide of the present disclosure can include one or more amino acid residue differences relative to a reference sequence, which is indicated by a list of the specified positions where residue differences are present relative to the reference sequence. In some embodiments, where more than one amino acid can be used in a specific residue position of a polypeptide, the various amino acid residues that can be used are separated by a "/" (e.g., X123F/X123M/X123V or X123F/M/V or 123F/M/V). The present disclosure includes engineered polypeptide sequences comprising one or more amino acid differences that include either/or both conservative and non-conservative amino acid substitutions.

The terms "amino acid substitution set" and "substitution set" refers to a group of amino acid substitutions within a polypeptide sequence. In some embodiments, substitution sets comprise 1, 2, 3, 4, 5, 6, 7, 8, 9, 10, 11, 12, 13, 14, 15, or more amino acid substitutions. In some embodiments, a substitution set refers to the set of amino acid substitutions that is present in any of the variant LDC polypeptides listed in any of the Tables in the Examples (i.e., Tables 1-2, 2-1, 3-2, 4-1, 5-1, 6-1, 7-1, 8-1, 8-2, 10-1, 11-1, and/or 11-2).

"Conservative amino acid substitution" refers to a substitution of a residue with a different residue having a similar side chain, and thus typically involves substitution of the amino acid in the polypeptide with amino acids within the same or similar defined class of amino acids. By way of example and not limitation, an amino acid with an aliphatic side chain may be substituted with another aliphatic amino acid (e.g., alanine, valine, leucine, and isoleucine); an amino acid with hydroxyl side chain is substituted with another amino acid with a hydroxyl side chain (e.g., serine and threonine); an amino acid having aromatic side chains is substituted with another amino acid having an aromatic side chain (e.g., phenylalanine, tyrosine, tryptophan, and histidine); an amino acid with a basic side chain is substituted with another amino acid with a basic side chain (e.g., lysine and arginine); an amino acid with an acidic side chain is substituted with another amino acid with an acidic side chain (e.g., aspartic acid or glutamic acid); and a hydrophobic or hydrophilic amino acid is replaced with another hydrophobic or hydrophilic amino acid, respectively. Exemplary conservative substitutions include the substitution of A, L, V, or I with other aliphatic residues (e.g., A, L, V, I) or other non-polar residues (e.g., A, L, V, I, G, M); substitution of G or M with other non-polar residues (e.g., A, L, V, I, G, M); substitution of D or E with other acidic residues (e.g., D, E); substitution of K or R with other basic residues (e.g., K, R); substitution of N, Q, S, or T with other polar residues (e.g., N, Q, S, T); substitution of H, Y, W, or F with other aromatic residues (e.g., H, Y, W, F); or substitution of C or P with other non-polar residues (e.g., C, P).

"Non-conservative substitution" refers to substitution of an amino acid in the polypeptide with an amino acid with significantly differing side chain properties. Non-conservative substitutions may use amino acids between, rather than within, the defined groups and affect: (a) the structure of the peptide backbone in the area of the substitution (e.g., proline for glycine); (b) the charge or hydrophobicity; and/or (c) the bulk of the side chain. By way of example and not limitation, exemplary non-conservative substitutions include an acidic amino acid substituted with a basic or aliphatic amino acid; an aromatic amino acid substituted with a small amino acid; and a hydrophilic amino acid substituted with a hydrophobic amino acid.

"Deletion" refers to modification to the polypeptide by removal of one or more amino acids from the reference polypeptide. Deletions can comprise removal of 1 or more amino acids, 2 or more amino acids, 5 or more amino acids, 10 or more amino acids, 15 or more amino acids, or 20 or more amino acids, up to 10% of the total number of amino acids, or up to 20% of the total number of amino acids making up the reference enzyme while retaining enzymatic activity and/or retaining the improved properties of an engineered leucine decarboxylase enzyme. Deletions can be directed to the internal portions and/or terminal portions of the polypeptide. In various embodiments, the deletion can comprise a continuous segment or can be discontinuous.

"Insertion" refers to modification to the polypeptide by addition of one or more amino acids from the reference polypeptide. Insertions can be in the internal portions of the polypeptide, or to the carboxy or amino terminus. Insertions as used herein include fusion proteins as is known in the art. The insertion can be a contiguous segment of amino acids or separated by one or more of the amino acids in the naturally occurring polypeptide.

The terms "functional fragment" and "biologically active fragment" are used interchangeably herein, to refer to a polypeptide that has an amino-terminal and/or carboxy-terminal deletion(s) and/or internal deletions, but where the remaining amino acid sequence is identical to the corresponding positions in the sequence to which it is being compared (e.g., a full length engineered LDC of the present invention) and that retains substantially all of the activity of the full-length polypeptide.

"Isolated polypeptide" refers to a polypeptide which is substantially separated from other contaminants that naturally accompany it (e.g., protein, lipids, and polynucleotides). The term embraces polypeptides which have been removed or purified from their naturally-occurring environment or expression system (e.g., host cell or in vitro synthesis). The recombinant LDC polypeptides may be present within a cell, present in the cellular medium, or prepared in various forms, such as lysates or isolated preparations. As such, in some embodiments, the recombinant LDC polypeptides provided herein are isolated polypeptides.

"Substantially pure polypeptide" refers to a composition in which the polypeptide species is the predominant species present (i.e., on a molar or weight basis it is more abundant than any other individual macromolecular species in the composition), and is generally a substantially purified composition when the object species comprises at least about 50 percent of the macromolecular species present by mole or % weight. Generally, a substantially pure LDC composition will comprise about 60% or more, about 70% or more, about 80% or more, about 90% or more, about 95% or more, and about 98% or more of all macromolecular species by mole or % weight present in the composition. In some embodiments, the object species is purified to essential homogeneity (i.e., contaminant species cannot be detected in the composition by conventional detection methods) wherein the composition consists essentially of a single macromolecular species. Solvent species, small molecules (<500 Daltons), and elemental ion species are not considered macromolecular species. In some embodiments, the isolated recombinant LDC polypeptides are substantially pure polypeptide compositions.

"Improved enzyme property" refers to an engineered LDC polypeptide that exhibits an improvement in any enzyme property as compared to a reference LDC polypeptide, such as a wild-type LDC polypeptide (e.g., wild-type LDC having SEQ ID NO: 2) or another engineered LDC polypeptide. Improved properties include but are not limited to such properties as increased protein production, increased serum stability, increased serum half-life in vivo, increased thermoactivity, increased thermostability, increased pH activity, increased stability, increased enzymatic activity, increased substrate specificity and/or affinity, increased specific activity, increased resistance to substrate and/or end-product inhibition, increased chemical stability, improved chemoselectivity, improved solvent stability, increased tolerance to acidic pH, increased tolerance to proteolytic activity (i.e., reduced sensitivity to proteolysis), reduced aggregation, increased solubility, reduced immunogenicity (i.e., reduced capability of inducing and/or eliciting an immune response), and altered temperature profile.

"Increased enzymatic activity" and "enhanced catalytic activity" refer to an improved property of the engineered LDC polypeptides, which can be represented by an increase in specific activity (e.g., product produced/time/weight protein) and/or an increase in percent conversion of the substrate to the product (e.g., percent conversion of starting amount of substrate to product in a specified time period using a specified amount of LDC) as compared to the reference LDC enzyme (e.g., wild-type LDC and/or another engineered LDC). Exemplary methods to determine enzyme activity are provided in the Examples. Any property relating to enzyme activity may be affected, including the classical enzyme properties of Km, Vmax or kcat, changes of which can lead to increased enzymatic activity.

Improvements in enzyme activity can be from about 1.1 fold the enzymatic activity of the corresponding wild-type enzyme, to as much as 2-fold, 5-fold, 10-fold, 20-fold, 25-fold, 50-fold, 75-fold, 100-fold, 150-fold, 200-fold or more enzymatic activity than the naturally occurring LDC or another engineered LDC from which the LDC polypeptides were derived.

In some embodiments, the engineered LDC polypeptides have a specific activity of at least 0.01 µmol/min-mg, at least 0.02/µmol/min-mg, at least 0.03/µmol/min-mg, at least 0.05/µmol/min-mg, at least 1.0/µmol/min-mg, and in some preferred embodiments greater than 2.0/µmol/min-mg. In some embodiments, the Km is in the range of about 1 µm to about 5 mM; in the range of about 5 µm to about 2 mM; in the range of about 10 µm to about 2 mM; or in the range of about 10 µm to about 1 mM. In some specific embodiments, the engineered LDC enzyme exhibits improved enzymatic activity in the range of 1.5 to 10 fold, 1.5 to 25 fold, 1.5 to 50 fold, 1.5 to 100 fold or greater, than that of the reference LDC enzyme. LDC activity can be measured by any standard assay known in the art (e.g., by monitoring depletion of reactants or formation of products). In some embodiments, the amount of products produced or the amount of substrate consumed is measured by High-Performance Liquid Chromatography (HPLC) separation combined with UV absorbance or mass spectra detection. In some embodiments, comparisons of enzyme activities are made using a defined preparation of enzyme, a defined assay under a set condition, and one or more defined substrates, as further described in detail herein. Generally, when lysates are compared, the numbers of cells and the amount of protein assayed are determined as well as use of identical expression systems and identical host cells, in order to minimize variations in amount of enzyme produced by the host cells and present in the lysates.

The phrase "increased storage stability" means that an engineered LDC polypeptide according to the invention will retain more activity compared to a reference LDC in a standard assay (e.g., as described in the Examples) after it has been produced in a dried form (e.g., by lyophilization or spray-drying), and stored for a period of time ranging from a few days to multiple months at a temperature above room temperature (e.g., 30° C., 37° C., 45° C., 55° C., etc.).

"Conversion" refers to the enzymatic conversion (or biotransformation) of substrate(s) to the corresponding product(s). "Percent conversion" refers to the percent of the substrate that is converted to the product within a period of time under specified conditions. Thus, the "enzymatic activity" or "activity" of a LDC polypeptide can be expressed as "percent conversion" of the substrate to the product in a specific period of time.

"Hybridization stringency" relates to hybridization conditions, such as washing conditions, in the hybridization of nucleic acids. Generally, hybridization reactions are performed under conditions of lower stringency, followed by washes of varying but higher stringency. The term "moderately stringent hybridization" refers to conditions that permit target-DNA to bind a complementary nucleic acid that has about 60% identity, preferably about 75% identity, about 85% identity to the target DNA, with greater than about 90% identity to target-polynucleotide. Exemplary moderately stringent conditions are conditions equivalent to hybridization in 50% formamide, 5×Denhart's solution, 5×SSPE, 0.2% SDS at 42° C., followed by washing in 0.2×SSPE, 0.2% SDS, at 42° C. "High stringency hybridization" refers generally to conditions that are about 10° C. or less from the thermal melting temperature Tm as determined under the solution condition for a defined polynucleotide sequence. In some embodiments, a high stringency condition refers to conditions that permit hybridization of only those nucleic acid sequences that form stable hybrids in 0.018M NaCl at 65° C. (i.e., if a hybrid is not stable in 0.018M NaCl at 65° C., it will not be stable under high stringency conditions, as contemplated herein). High stringency conditions can be provided, for example, by hybridization in conditions equivalent to 50% formamide, 5×Denhart's solution, 5×SSPE, 0.2% SDS at 42° C., followed by washing in 0.1×SSPE, and 0.1% SDS at 65° C. Another high stringency condition is hybridizing in conditions equivalent to hybridizing in 5×SSC containing 0.1% (w:v) SDS at 65° C. and washing in 0.1×SSC containing 0.1% SDS at 65° C. Other high stringency hybridization conditions, as well as moderately stringent conditions, are described in the references cited above.

"Codon optimized" refers to changes in the codons of the polynucleotide encoding a protein to those preferentially used in a particular organism such that the encoded protein is more efficiently expressed in that organism. Although the genetic code is degenerate, in that most amino acids are represented by several codons, called "synonyms" or "synonymous" codons, it is well known that codon usage by particular organisms is nonrandom and biased towards particular codon triplets. This codon usage bias may be higher in reference to a given gene, genes of common function or ancestral origin, highly expressed proteins versus low copy number proteins, and the aggregate protein coding regions of an organism's genome. In some embodiments, the polynucleotides encoding the LDC enzymes are codon optimized for optimal production from the host organism selected for expression. "Control sequence" refers herein to include all components that are necessary or advantageous for the expression of a polynucleotide and/or polypeptide of the present disclosure. Each control sequence may be native or foreign to the nucleic acid sequence encoding the polypeptide. Such control sequences include, but are not limited to, leaders, polyadenylation sequences, propeptide sequences, promoter sequences, signal peptide sequences, initiation sequences, and transcription terminators. At a minimum, the control sequences include a promoter, and transcriptional and translational stop signals. In some embodiments, the control sequences are provided with linkers for the purpose of introducing specific restriction sites facilitating ligation of the control sequences with the coding region of the nucleic acid sequence encoding a polypeptide.

"Operably linked" is defined herein as a configuration in which a control sequence is appropriately placed (i.e., in a functional relationship) at a position relative to a polynucleotide of interest such that the control sequence directs or regulates the expression of the polynucleotide encoding a polypeptide of interest.

"Promoter sequence" refers to a nucleic acid sequence that is recognized by a host cell for expression of a polynucleotide of interest, such as a coding sequence. The promoter sequence contains transcriptional control sequences that mediate the expression of a polynucleotide of interest. The promoter may be any nucleic acid sequence which shows transcriptional activity in the host cell of choice including mutant, truncated, and hybrid promoters, and may be obtained from genes encoding extracellular or intracellular polypeptides either homologous or heterologous to the host cell.

"Substrate" in the context of an enzymatic conversion reaction process refers to the compound or molecule acted on by the LDC polypeptide. "Product" in the context of an enzymatic conversion process refers to the compound or molecule resulting from the action of the LDC polypeptide on the substrate.

As used herein the term "culturing" refers to the growing of a population of microbial cells under suitable conditions using any suitable medium (e.g., liquid, gel, or solid).

Recombinant polypeptides (e.g., LDC enzyme variants) can be produced using any suitable methods known in the art. For example, there is a wide variety of different mutagenesis techniques well known to those skilled in the art. In addition, mutagenesis kits are also available from many commercial molecular biology suppliers. Methods are available to make specific substitutions at defined amino acids (site-directed), specific or random mutations in a localized region of the gene (regio-specific), or random mutagenesis over the entire gene (e.g., saturation mutagenesis). Numerous suitable methods are known to those in the art to generate enzyme variants, including but not limited to site-directed mutagenesis of single-stranded DNA or double-stranded DNA using PCR, cassette mutagenesis, gene synthesis, error-prone PCR, shuffling, and chemical saturation mutagenesis, or any other suitable method known in the art. Non-limiting examples of methods used for DNA and protein engineering are provided in the following patents: U.S. Pat. Nos. 6,117,679; 6,420,175; 6,376,246; 6,586,182; 7,747,391; 7,747,393; 7,783,428; and 8,383,346. After the variants are produced, they can be screened for any desired property (e.g., high or increased activity, or low or reduced activity, increased thermal activity, increased thermal stability, and/or acidic pH stability, etc.). In some embodiments, "recombinant LDC polypeptides" (also referred to herein as "engineered LDC polypeptides," "variant LDC enzymes," and "LDC variants") find use.

As used herein, a "vector" is a DNA construct for introducing a DNA sequence into a cell. In some embodiments, the vector is an expression vector that is operably linked to a suitable control sequence capable of effecting the expression in a suitable host of the polypeptide encoded in the DNA sequence. In some embodiments, an "expression vector" has a promoter sequence operably linked to the DNA sequence (e.g., transgene) to drive expression in a host cell, and in some embodiments, also comprises a transcription terminator sequence.

As used herein, the term "expression" includes any step involved in the production of the polypeptide including, but not limited to, transcription, post-transcriptional modification, translation, and post-translational modification. In some embodiments, the term also encompasses secretion of the polypeptide from a cell.

As used herein, an amino acid or nucleotide sequence (e.g., a promoter sequence, signal peptide, terminator sequence, etc.) is "heterologous" to another sequence with which it is operably linked if the two sequences are not associated in nature.

As used herein, the terms "host cell" and "host strain" refer to suitable hosts for expression vectors comprising DNA provided herein (e.g., a polynucleotide sequences encoding at least one LDC variant). In some embodiments, the host cells are prokaryotic or eukaryotic cells that have been transformed or transfected with vectors constructed using recombinant DNA techniques as known in the art.

The term "analogue" means a polypeptide having more than 70% sequence identity but less than 100% sequence identity (e.g., more than 75%, 78%, 80%, 83%, 85%, 88%, 90%, 91%, 92%, 93%, 94%, 95%, 96%, 97%, 98%, 99% sequence identity) with a reference polypeptide. In some embodiments, analogues refer to non-naturally occurring amino acid residues including, but not limited to, homoarginine, ornithine and norvaline, as well as naturally occurring amino acids. In some embodiments, analogues also include one or more D-amino acid residues and non-peptide linkages between two or more amino acid residues.

The term "therapeutic" refers to a compound administered to a subject who shows signs or symptoms of pathology having beneficial or desirable medical effects.

The term "pharmaceutical composition" refers to a composition suitable for pharmaceutical use in a mammalian subject (e.g., human) comprising a pharmaceutically effective amount of an engineered LDC polypeptide encompassed by the invention and an acceptable carrier.

The term "gene therapy" is used in reference to the use of genes (i.e., genetic material) to treat and/or prevent disease in a mammalian subject (e.g., human). In some embodiments, the genetic material is introduced directly into at least some cells of the mammalian subject. It is not intended that the present invention be limited to any specific method(s) or composition(s) useful for gene therapy.

The term "mRNA therapy" is used in reference to the use of messenger RNA (mRNA) to treat and/or prevent disease in a mammalian subject (e.g., human). In some embodiments, the genetic material is introduced directly into at least some cells of the mammalian subject. It is not intended that the present invention be limited to any specific method(s) or composition(s) useful for mRNA therapy.

The term "effective amount" means an amount sufficient to produce the desired result. One of general skill in the art may determine what the effective amount by using routine experimentation.

The terms "isolated" and "purified" are used to refer to a molecule (e.g., an isolated nucleic acid, polypeptide, etc.) or other component that is removed from at least one other component with which it is naturally associated. The term "purified" does not require absolute purity, rather it is intended as a relative definition.

The term "subject" encompasses mammals such as humans, non-human primates, livestock, companion animals, and laboratory animals (e.g., rodents and lagamorphs). It is intended that the term encompass females as well as males.

As used herein, the term "patient" means any subject that is being assessed for, treated for, or is experiencing disease.

The term "infant" refers to a child in the period of the first month after birth to approximately one (1) year of age. As used herein, the term "newborn" refers to child in the period from birth to the 28th day of life. The term "premature infant" refers to an infant born after the twentieth completed week of gestation, yet before full term, generally weighing ~500 to ~2499 grams at birth. A "very low birth weight infant" is an infant weighing less than 1500 g at birth.

As used herein, the term "child" refers to a person who has not attained the legal age for consent to treatment or research procedures. In some embodiments, the term refers to a person between the time of birth and adolescence.

As used herein, the term "adult" refers to a person who has attained legal age for the relevant jurisdiction (e.g., 18 years of age in the United States). In some embodiments, the term refers to any fully grown, mature organism. In some embodiments, the term "young adult" refers to a person less than 18 years of age, but who has reached sexual maturity.

As used herein, "composition" and "formulation" encompass products comprising at least one engineered LDC of the present invention, intended for any suitable use (e.g., pharmaceutical compositions, dietary/nutritional supplements, feed, etc.).

The terms "administration" and "administering" a composition mean providing a composition of the present invention to a subject (e.g., to a person suffering from the effects of MSUD).

The term "carrier" when used in reference to a pharmaceutical composition means any of the standard pharmaceutical carrier, buffers, and excipients, such as stabilizers, preservatives, and adjuvants.

The term "pharmaceutically acceptable" means a material that can be administered to a subject without causing any undesirable biological effects or interacting in a deleterious manner with any of the components in which it is contained and that possesses the desired biological activity.

As used herein, the term "excipient" refers to any pharmaceutically acceptable additive, carrier, diluent, adjuvant, or other ingredient, other than the active pharmaceutical ingredient (API; e.g., the engineered LDC polypeptides of the present invention). Excipients are typically included for formulation and/or administration purposes.

The term "therapeutically effective amount" when used in reference to symptoms of disease/condition refers to the amount and/or concentration of a compound (e.g., engineered LDC polypeptides) that ameliorates, attenuates, or eliminates one or more symptom of a disease/condition or prevents or delays the onset of symptom(s) (e.g., MSUD). In some embodiments, the term is use in reference to the amount of a composition that elicits the biological (e.g., medical) response by a tissue, system, or animal subject that is sought by the researcher, physician, veterinarian, or other clinician.

The term "therapeutically effective amount" when used in reference to a disease/condition refers to the amount and/or concentration of a composition that ameliorates, attenuates, or eliminates the disease/condition.

It is intended that the terms "treating," "treat" and "treatment" encompass preventative (e.g., prophylactic), as well as palliative treatment.

As used herein, the term "at least one" is not intended to limit the invention to any particular number of items. It is intended to encompass one, two, three, four, five, six, seven, eight, nine, ten, or more items, as desired.

Engineered LDC Polypeptides:

The parent LDC polypeptides from which the engineered LDC polypeptides of the invention are derived from include bacterial strains such as those in the Planctomycetaceae family bacteria.

Furthermore, when a particular LDC variant (i.e., an engineered LDC polypeptide) is referred to by reference to modification of particular amino acids residues in the sequence of a wild-type LDC or reference LDC it is to be understood that variants of another LDC modified in the equivalent position(s) (as determined from the optional amino acid sequence alignment between the respective amino acid sequences) are encompassed herein.

In some embodiments, engineered LDC polypeptides are produced by cultivating a microorganism comprising at least one polynucleotide sequence encoding at least one engineered LDC polypeptide under conditions which are conducive for producing the engineered LDC polypeptide. In some embodiments, the engineered LDC polypeptide is subsequently recovered from the resulting culture medium and/or cells.

The present invention provides exemplary engineered LDC polypeptides having LDC activity. The Examples provide Tables (i.e., Tables 1-2, 2-1, 3-2, 4-1, 5-1, 6-1, 7-1, 8-1, 8-2, 10-1, 11-1, and/or 11-2) showing sequence structural information correlating specific amino acid sequence features with the functional activity of the engineered LDC polypeptides. This structure-function correlation information is provided in the form of specific amino acid residue differences relative to the reference engineered polypeptide of SEQ ID NO: 2, as well as associated experimentally determined activity data for the exemplary engineered LDC polypeptides.

In some embodiments, the engineered LDC polypeptides of the present invention having LDC activity comprise a) an amino acid sequence having at least 85% sequence identity to reference sequence SEQ ID NO: 2; b) an amino acid residue difference as compared to SEQ ID NO: 2 at one or more amino acid positions; and c) which exhibits an improved property selected from i) enhanced catalytic activity, ii) reduced proteolytic sensitivity, iii) reduced aggregation, iv) increased stability as a lyophilized preparation to elevated temperatures, v) reduced immunogenicity, or a combination of any of i), ii), iii), iv), or v), as compared to the reference sequence.

In some embodiments, the present invention provides functional fragments of engineered LDC polypeptides. In some embodiments, functional fragments comprise at least about 90%, at least about 95%, at least about 96%, at least about 97%, at least about 98%, or at least about 99% of the activity of the engineered LDC polypeptide from which it was derived (i.e., the parent engineered LDC). In some embodiments, functional fragments comprise at least about 90%, at least about 91%, at least about 92%, at least about 93%, at least about 94%, at least about 95%, at least about 96%, at least about 97%, at least about 98%, or at least about 99% of the parent sequence of the engineered LDC. In some embodiments the functional fragment is truncated by less than 5, less than 10, less than 15, less than 10, less than 25, less than 30, less than 35, less than 40, less than 45, and less than 50 amino acids.

In some embodiments, the present invention provides functional fragments of engineered LDC polypeptides. In some embodiments, functional fragments comprise at least about 95%, 96%, 97%, 98%, or 99% of the activity of the engineered LDC polypeptide from which it was derived (i.e., the parent engineered LDC). In some embodiments, functional fragments comprise at least 90%, 91%, 92%, 93%, 94%, 95%, 96%, 97%, 98%, or 99% of the parent sequence of the engineered LDC. In some embodiments the functional fragment is truncated by less than 5, less than 10, less than 15, less than 10, less than 25, less than 30, less than 35, less than 40, less than 45, less than 50, less than 55, less than 60, less than 65, or less than 70 amino acids.

In some embodiments, the engineered LDC polypeptide comprises an amino acid sequence having at least about 80%, 85%, 86%, 87%, 88%, 89%, 90%, 91%, 92%, 93%, 94%, 95%, 96%, 97%, 98%, 99% or more identity to a reference sequence selected from SEQ ID NOS: 2, 4, 6, 8, 10, 12, 14, 38, 234, 284, 484, 594, 686, 688, and/or 766, or the amino acid sequence of any variant (e.g., those provided in the Examples). In some embodiments, the reference sequence is selected from SEQ ID NOS: 2, 4, 6, 8, 10, 12, 14, 38, 234, 284, 484, 594, 686, 688, and/or 766.

In some embodiments, the engineered LDC polypeptide comprises an amino acid sequence having at least 80%, 85%, 86%, 87%, 88%, 89%, 90%, 91%, 92%, 93%, 94%, 95%, 96%, 97%, 98%, 99%, or more sequence identity to reference sequence SEQ ID NO: 2, 4, 6, 8, 10, 12, 14, 38, 234, 284, 484, 594, 686, 688, and/or 766, and one or more residue differences as compared to SEQ ID NO: 2, 4, 6, 8, 10, 12, 14, 38, 234, 284, 484, 594, 686, 688, and/or 766.

Polynucleotides Encoding Engineered Polypeptides, Expression Vectors and Host Cells:

The present invention provides polynucleotides encoding the engineered LDC polypeptides described herein. In some embodiments, the polynucleotides are operatively linked to one or more heterologous regulatory sequences that control gene expression to create a recombinant polynucleotide capable of expressing the polypeptide. In some embodiments, expression constructs containing at least one heterologous polynucleotide encoding the engineered LDC polypeptide(s) is introduced into appropriate host cells to express the corresponding LDC polypeptide(s).

As will be apparent to the skilled artisan, availability of a protein sequence and the knowledge of the codons corresponding to the various amino acids provide a description of all the polynucleotides capable of encoding the subject polypeptides. The degeneracy of the genetic code, where the same amino acids are encoded by alternative or synonymous codons, allows an extremely large number of nucleic acids to be made, all of which encode an engineered LDC polypeptide. Thus, the present invention provides methods and compositions for the production of each and every possible variation of LDC polynucleotides that could be made that encode the LDC polypeptides described herein by selecting combinations based on the possible codon choices, and all such variations are to be considered specifically disclosed for any polypeptide described herein, including the amino acid sequences presented in the Examples (e.g., in Tables 1-2, 2-1, 3-2, 4-1, 5-1, 6-1, 7-1, 8-1, 8-2, 10-1, 11-1, and/or 11-2).

In some embodiments, the codons are preferably optimized for utilization by the chosen host cell for protein production. For example, preferred codons used in bacteria are typically used for expression in bacteria. Consequently, codon optimized polynucleotides encoding the engineered LDC polypeptides contain preferred codons at about 40%, 50%, 60%, 70%, 80%, 90%, or greater than 90% of the codon positions in the full-length coding region.

In some embodiments, the LDC polynucleotide encodes an engineered polypeptide having LDC activity with the properties disclosed herein, wherein the polypeptide comprises an amino acid sequence having at least 80%, 85%, 86%, 87%, 88%, 89%, 90%, 91%, 92%, 93%, 94%, 95%, 96%, 97%, 98%, 99% or more identity to a reference sequence selected from SEQ ID NOS: 2, 4, 6, 8, 10, 12, 14, 38, 234, 284, 484, 594, 686, 688, and/or 766, or the amino acid sequence of any variant (e.g., those provided in the Examples), and one or more residue differences as compared to the reference polynucleotide of SEQ ID NOS: 1, 3, 5, 7, 9, 11, 13, 37, 233, 283, 483, 593, 685, 687, and/or 765, or the amino acid sequence of any variant as disclosed in the Examples (for example 1, 2, 3, 4, 5, 6, 7, 8, 9, 10 or more amino acid residue positions). In some embodiments, the reference sequence is selected from SEQ ID NOS: 2, 4, 6, 8, 10, 12, 14, 38, 234, 284, 484, 594, 686, 688, and/or 766.

In some embodiments, the LDC polynucleotide encodes an engineered polypeptide having LDC activity with the properties disclosed herein, wherein the polypeptide comprises an amino acid sequence having at least 80%, 85%, 86%, 87%, 88%, 89%, 90%, 91%, 92%, 93%, 94%, 95%, 96%, 97%, 98%, 99%, or more sequence identity to reference sequence SEQ ID NO: 2, 4, 6, 8, 10, 12, 14, 38, 234, 284, 484, 594, 686, 688, and/or 766, and one or more residue differences as compared to SEQ ID NO: 2, 4, 6, 8, 10, 12, 14, 38, 234, 284, 484, 594, 686, 688, and/or 766.

In some embodiments, the polynucleotide encoding the engineered LDC polypeptides comprises a polynucleotide sequence selected from a polynucleotide sequence selected from SEQ ID NOS: 1, 3, 5, 7, 9, 11, 13, 37, 233, 283, 483, 593, 685, 687, and/or 765. In some embodiments, the polynucleotide encoding an engineered LDC polypeptide has at least 80%, 85%, 90%, 93%, 95%, 96%, 97%, 98%, 99% nucleotide residue identity to SEQ ID NOS: 1, 3, 5, 7, 9, 11, 13, 37, 233, 283, 483, 593, 685, 687, and/or 765.

In some embodiments, the polynucleotides are capable of hybridizing under highly stringent conditions to a reference polynucleotide sequence selected from SEQ ID NOS: 2, 4, 6, 8, 10, 12, 14, 38, 234, 284, 484, 594, 686, 688, and/or 766, or a complement thereof, or a polynucleotide sequence encoding any of the variant LDC polypeptides provided herein. In some embodiments, the polynucleotide capable of hybridizing under highly stringent conditions encodes a LDC polypeptide comprising an amino acid sequence that has one or more residue differences as compared to SEQ ID NO: 2, 4, 6, 8, 10, 12, 14, 38, 234, 284, 484, 594, 686, 688, and/or 766.

In some embodiments, an isolated polynucleotide encoding any of the engineered LDC polypeptides herein is manipulated in a variety of ways to facilitate expression of the LDC polypeptide. In some embodiments, the polynucleotides encoding the LDC polypeptides comprise expression vectors where one or more control sequences is present to regulate the expression of the LDC polynucleotides and/or polypeptides. Manipulation of the isolated polynucleotide prior to its insertion into a vector may be desirable or necessary depending on the expression vector utilized. Techniques for modifying polynucleotides and nucleic acid sequences utilizing recombinant DNA methods are well known in the art. In some embodiments, the control sequences include among others, promoters, leader sequences, polyadenylation sequences, propeptide sequences, signal peptide sequences, and transcription terminators. In some embodiments, suitable promoters are selected based on the host cells selection. For bacterial host cells, suitable promoters for directing transcription of the nucleic acid constructs of the present disclosure, include, but are not limited to promoters obtained from the *E. coli* lac operon, *Streptomyces coelicolor* agarase gene (dagA), *Bacillus subtilis* levansucrase gene (sacB), *Bacillus licheniformis* alpha-amylase gene (amyL), *Bacillus stearothermophilus* maltogenic amylase gene (amyM), *Bacillus amyloliquefaciens* alpha-amylase gene (amyQ), *Bacillus licheniformis* penicillinase gene (penP), *Bacillus subtilis* xylA and xylB genes, and prokaryotic beta-lactamase gene (See e.g., Villa-Kamaroff et al., Proc. Natl Acad. Sci. USA 75:3727-3731 [1978]), as well as the tac promoter (See e.g., DeBoer et al., Proc. Natl Acad. Sci. USA 80: 21-25 [1983]). Exemplary promoters for filamentous fungal host cells, include, but are not limited to promoters obtained from the genes for *Aspergillus oryzae* TAKA amylase, *Rhizomucor miehei* aspartic proteinase, *Aspergillus niger* neutral alpha-amylase, *Aspergillus niger* acid stable alpha-amylase, *Aspergillus niger* or *Aspergillus awamori* glucoamylase (glaA), *Rhizomucor miehei* lipase, *Aspergillus oryzae* alkaline protease, *Aspergillus oryzae* triose phosphate isomerase, *Aspergillus nidulans* acetamidase, and *Fusarium oxysporum* trypsin-like protease (See e.g., WO 96/00787), as well as the NA2-tpi promoter (a hybrid of the promoters from the genes for *Aspergillus niger* neutral alpha-amylase and *Aspergillus oryzae* triose phosphate isomerase), and mutant, truncated, and hybrid promoters thereof. Exemplary yeast cell promoters can be from the genes for *Saccharomyces cerevisiae* enolase (ENO-1), *Saccharomyces cerevisiae* galactokinase (GAL1), *Saccharomyces cerevisiae* alcohol dehydrogenase/glyceraldehyde-3-phosphate dehydrogenase (ADH2/GAP), and *Saccharomyces cerevisiae* 3-phosphoglycerate kinase. Other useful promoters for yeast host cells are known in the art (See e.g., Romanos et al., Yeast 8:423-488 [1992]).

In some embodiments, the control sequence is also a suitable transcription terminator sequence (i.e., a sequence recognized by a host cell to terminate transcription). In some embodiments, the terminator sequence is operably linked to the 3' terminus of the nucleic acid sequence encoding the LDC polypeptide. Any suitable terminator which is functional in the host cell of choice finds use in the present invention. Exemplary transcription terminators for filamentous fungal host cells can be obtained from the genes for *Aspergillus oryzae* TAKA amylase, *Aspergillus niger* glucoamylase, *Aspergillus nidulans* anthranilate synthase, *Aspergillus niger* alpha-glucosidase, and *Fusarium oxysporum* trypsin-like protease. Exemplary terminators for yeast host cells can be obtained from the genes for *Saccharomyces cerevisiae* enolase, *Saccharomyces cerevisiae* cytochrome C (CYC1), and *Saccharomyces cerevisiae* glyceraldehyde-3-phosphate dehydrogenase. Other useful terminators for yeast host cells are known in the art (See e.g., Romanos et al., supra).

In some embodiments, the control sequence is also a suitable leader sequence (i.e., a non-translated region of an mRNA that is important for translation by the host cell). In some embodiments, the leader sequence is operably linked to the 5' terminus of the nucleic acid sequence encoding the LDC polypeptide. Any suitable leader sequence that is functional in the host cell of choice find use in the present invention. Exemplary leaders for filamentous fungal host cells are obtained from the genes for *Aspergillus oryzae* TAKA amylase, and *Aspergillus nidulans* triose phosphate isomerase. Suitable leaders for yeast host cells are obtained from the genes for *Saccharomyces cerevisiae* enolase (ENO-1), *Saccharomyces cerevisiae* 3-phosphoglycerate kinase, *Saccharomyces cerevisiae* alpha-factor, and *Saccharomyces cerevisiae* alcohol dehydrogenase/glyceraldehyde-3-phosphate dehydrogenase (ADH2/GAP).

In some embodiments, the control sequence is also a polyadenylation sequence (i.e., a sequence operably linked to the 3' terminus of the nucleic acid sequence and which, when transcribed, is recognized by the host cell as a signal to add polyadenosine residues to transcribed mRNA). Any suitable polyadenylation sequence which is functional in the host cell of choice finds use in the present invention. Exemplary polyadenylation sequences for filamentous fungal host cells include, but are not limited to the genes for *Aspergillus oryzae* TAKA amylase, *Aspergillus niger* glucoamylase, *Aspergillus nidulans* anthranilate synthase, *Fusarium oxysporum* trypsin-like protease, and *Aspergillus niger* alpha-glucosidase. Useful polyadenylation sequences for yeast host cells are known (See e.g., Guo and Sherman, Mol. Cell. Bio., 15:5983-5990 [1995]).

In some embodiments, the control sequence is also a signal peptide (i.e., a coding region that codes for an amino acid sequence linked to the amino terminus of a polypeptide and directs the encoded polypeptide into the cell's secretory pathway). In some embodiments, the 5' end of the coding sequence of the nucleic acid sequence inherently contains a signal peptide coding region naturally linked in translation reading frame with the segment of the coding region that encodes the secreted polypeptide. Alternatively, in some embodiments, the 5' end of the coding sequence contains a signal peptide coding region that is foreign to the coding sequence. Any suitable signal peptide coding region which directs the expressed polypeptide into the secretory pathway of a host cell of choice finds use for expression of the engineered polypeptide(s). Effective signal peptide coding regions for bacterial host cells are the signal peptide coding regions include, but are not limited to those obtained from the genes for *Bacillus* NCIB 11837 maltogenic amylase, *Bacillus stearothermophilus* alpha-amylase, *Bacillus licheniformis* subtilisin, *Bacillus licheniformis* beta-lactamase, *Bacillus stearothermophilus* neutral proteases (nprT, nprS, nprM), and *Bacillus subtilis* prsA. Further signal peptides are known in the art (See e.g., Simonen and Palva, Microbiol. Rev., 57:109-137 [1993]). In some embodiments, effective signal peptide coding regions for filamentous fungal host cells include, but are not limited to the signal peptide coding regions obtained from the genes for *Aspergillus oryzae* TAKA amylase, *Aspergillus niger* neutral amylase, *Aspergillus niger* glucoamylase, *Rhizomucor miehei* aspartic proteinase, *Humicola insolens* cellulase, and *Humicola lanuginosa* lipase. Useful signal peptides for yeast host cells include, but are not limited to those from the genes for *Saccharomyces cerevisiae* alpha-factor and *Saccharomyces cerevisiae* invertase.

In some embodiments, the control sequence is also a propeptide coding region that codes for an amino acid sequence positioned at the amino terminus of a polypeptide. The resultant polypeptide is referred to as a "proenzyme," "propolypeptide," or "zymogen." A propolypeptide can be converted to a mature active polypeptide by catalytic or autocatalytic cleavage of the propeptide from the propolypeptide. The propeptide coding region may be obtained from any suitable source, including, but not limited to the genes for *Bacillus subtilis* alkaline protease (aprE), *Bacillus subtilis* neutral protease (nprT), *Saccharomyces cerevisiae* alpha-factor, *Rhizomucor miehei* aspartic proteinase, and *Myceliophthora thermophila* lactase (See e.g., WO 95/33836). Where both signal peptide and propeptide regions are present at the amino terminus of a polypeptide, the propeptide region is positioned next to the amino terminus of a polypeptide and the signal peptide region is positioned next to the amino terminus of the propeptide region.

In some embodiments, regulatory sequences are also utilized. These sequences facilitate the regulation of the expression of the polypeptide relative to the growth of the host cell. Examples of regulatory systems are those that cause the expression of the gene to be turned on or off in response to a chemical or physical stimulus, including the presence of a regulatory compound. In prokaryotic host cells, suitable regulatory sequences include, but are not limited to the lac, tac, and trp operator systems. In yeast host cells, suitable regulatory systems include, but are not limited to the ADH2 system or GAL1 system. In filamentous fungi, suitable regulatory sequences include, but are not limited to the TAKA alpha-amylase promoter, *Aspergillus niger* glucoamylase promoter, and *Aspergillus oryzae* glucoamylase promoter.

In another aspect, the present invention is directed to a recombinant expression vector comprising a polynucleotide encoding an engineered LDC polypeptide, and one or more expression regulating regions such as a promoter and a terminator, a replication origin, etc., depending on the type of hosts into which they are to be introduced. In some embodiments, the various nucleic acid and control sequences described herein are joined together to produce recombinant expression vectors which include one or more convenient restriction sites to allow for insertion or substitution of the nucleic acid sequence encoding the LDC polypeptide at such sites. Alternatively, in some embodiments, the nucleic acid sequence of the present invention is expressed by inserting the nucleic acid sequence or a nucleic acid construct comprising the sequence into an appropriate vector for expression. In some embodiments involving the creation of the expression vector, the coding sequence is located in the vector so that the coding sequence is operably linked with the appropriate control sequences for expression.

The recombinant expression vector may be any suitable vector (e.g., a plasmid or virus), that can be conveniently subjected to recombinant DNA procedures and bring about the expression of the LDC polynucleotide sequence. The choice of the vector typically depends on the compatibility of the vector with the host cell into which the vector is to be introduced. The vectors may be linear or closed circular plasmids.

In some embodiments, the expression vector is an autonomously replicating vector (i.e., a vector that exists as an extra-chromosomal entity, the replication of which is independent of chromosomal replication, such as a plasmid, an extra-chromosomal element, a minichromosome, or an artificial chromosome). The vector may contain any means for assuring self-replication. In some alternative embodiments, the vector is one in which, when introduced into the host cell, it is integrated into the genome and replicated together with the chromosome(s) into which it has been integrated. Furthermore, in some embodiments, a single vector or plasmid, or two or more vectors or plasmids which together contain the total DNA to be introduced into the genome of the host cell, and/or a transposon is utilized.

In some embodiments, the expression vector contains one or more selectable markers, which permit easy selection of transformed cells. A "selectable marker" is a gene, the product of which provides for biocide or viral resistance, resistance to heavy metals, prototrophy to auxotrophs, and the like. Examples of bacterial selectable markers include, but are not limited to the dal genes from *Bacillus subtilis* or *Bacillus licheniformis*, or markers, which confer antibiotic resistance such as ampicillin, kanamycin, chloramphenicol or tetracycline resistance. Suitable markers for yeast host cells include, but are not limited to ADE2, HIS3, LEU2, LYS2, MET3, TRP1, and URA3. Selectable markers for use in filamentous fungal host cells include, but are not limited to, amdS (acetamidase; e.g., from *A. nidulans* or *A. orzyae*), argB (ornithine carbamoyltransferases), bar (phosphinothricin acetyltransferase; e.g., from *S. hygroscopicus*), hph (hygromycin phosphotransferase), niaD (nitrate reductase), pyrG (orotidine-5'-phosphate decarboxylase; e.g., from *A. nidulans* or *A. orzyae*), sC (sulfate adenyltransferase), and trpC (anthranilate synthase), as well as equivalents thereof. In another aspect, the present invention provides a host cell comprising at least one polynucleotide encoding at least one engineered LDC polypeptide of the present invention, the polynucleotide(s) being operatively linked to one or more control sequences for expression of the engineered LDC enzyme(s) in the host cell. Host cells suitable for use in expressing the polypeptides encoded by the expression vectors of the present invention are well known in the art and include but are not limited to, bacterial cells, such as *E. coli, Vibrio fluvialis, Streptomyces* and *Salmonella typhimurium* cells; fungal cells, such as yeast cells (e.g., *Saccharomyces cerevisiae* or *Pichia pastoris* (ATCC Accession No. 201178)); insect cells such as *Drosophila* S2 and *Spodoptera* Sf9 cells; animal cells such as CHO, COS, BHK, 293, and Bowes melanoma cells; and plant cells. Exemplary host cells also include various *Escherichia coli* strains (e.g., W3110 (ΔfhuA) and BL21).

Accordingly, in another aspect, the present invention provides methods of producing the engineered LDC polypeptides, where the methods comprise culturing a host cell capable of expressing a polynucleotide encoding the engineered LDC polypeptide under conditions suitable for expression of the polypeptide. In some embodiments, the methods further comprise the steps of isolating and/or purifying the LDC polypeptides, as described herein.

Appropriate culture media and growth conditions for host cells are well known in the art. It is contemplated that any suitable method for introducing polynucleotides for expression of the LDC polypeptides into cells will find use in the present invention. Suitable techniques include, but are not limited to electroporation, biolistic particle bombardment, liposome mediated transfection, calcium chloride transfection, and protoplast fusion.

Engineered LDC polypeptides with the properties disclosed herein can be obtained by subjecting the polynucleotide encoding the naturally occurring or engineered LDC polypeptide to any suitable mutagenesis and/or directed evolution methods known in the art, and/or as described herein. An exemplary directed evolution technique is mutagenesis and/or DNA shuffling (See e.g., Stemmer, Proc. Natl. Acad. Sci. USA 91:10747-10751 [1994]; WO 95/22625; WO 97/0078; WO 97/35966; WO 98/27230; WO 00/42651; WO 01/75767 and U.S. Pat. No. 6,537,746). Other directed evolution procedures that can be used include, among others, staggered extension process (StEP), in vitro recombination (See e.g., Zhao et al., Nat. Biotechnol., 16:258-261 [1998]), mutagenic PCR (See e.g., Caldwell et al., PCR Methods Appl., 3:S136-S140 [1994]), and cassette mutagenesis (See e.g., Black et al., Proc. Natl. Acad. Sci. USA 93:3525-3529 [1996]).

Mutagenesis and directed evolution methods can be readily applied to LDC-encoding polynucleotides to generate variant libraries that can be expressed, screened, and assayed. Any suitable mutagenesis and directed evolution methods find use in the present invention and are well known in the art (See e.g., U.S. Pat. Nos. 5,605,793, 5,811,238, 5,830,721, 5,834,252, 5,837,458, 5,928,905, 6,096,548, 6,117,679, 6, 132,970, 6, 165,793, 6, 180,406, 6,251,674, 6,265,201, 6,277,638, 6,287,861, 6,287,862, 6,291,242, 6,297,053, 6,303,344, 6,309,883, 6,319,713, 6,319,714, 6,323,030, 6,326,204, 6,335,160, 6,335,198, 6,344,356, 6,352,859, 6,355,484, 6,358,740, 6,358,742, 6,365,377, 6,365,408, 6,368,861, 6,372,497, 6,337,186, 6,376,246, 6,379,964, 6,387,702, 6,391,552, 6,391,640, 6,395,547, 6,406,855, 6,406,910, 6,413,745, 6,413,774, 6,420, 175, 6,423,542, 6,426,224, 6,436,675, 6,444,468, 6,455,253, 6,479,652, 6,482,647, 6,483,011, 6,484, 105, 6,489,146, 6,500,617, 6,500,639, 6,506,602, 6,506,603, 6,518,065, 6,519,065, 6,521,453, 6,528,311, 6,537,746, 6,573,098, 6,576,467, 6,579,678, 6,586,182, 6,602,986, 6,605,430, 6,613,514, 6,653,072, 6,686,515, 6,703,240, 6,716,631, 6,825,001, 6,902,922, 6,917,882, 6,946,296, 6,961,664, 6,995,017, 7,024,312, 7,058,515, 7,105,297, 7,148,054, 7,220,566, 7,288,375, 7,384,387, 7,421,347, 7,430,477, 7,462,469, 7,534,564, 7,620,500, 7,620,502, 7,629,170, 7,702,464, 7,747,391, 7,747,393, 7,751,986, 7,776,598, 7,783,428, 7,795,030, 7,853,410, 7,868,138, 7,783,428, 7,873,477, 7,873,499, 7,904,249, 7,957,912, 7,981,614, 8,014,961, 8,029,988, 8,048,674, 8,058,001, 8,076, 138, 8,108, 150, 8, 170,806, 8,224,580, 8,377,681, 8,383,346, 8,457,903, 8,504,498, 8,589,085, 8,762,066, 8,768,871, 9,593,326, 9,665,694, 9,684,771, and all related US and non-US counterparts; Ling et al., Anal. Biochem., 254(2): 157-78 [1997]; Dale et al., Meth. Mol. Biol., 57:369-74 [1996]; Smith, Ann. Rev. Genet., 19:423-462 [1985]; Botstein et al., Science, 229:1193-1201 [1985]; Carter, Biochem. J., 237:1-7 [1986]; Kramer et al., Cell, 38:879-887 [1984]; Wells et al., Gene, 34:315-323 [1985]; Minshull et al., Curr. Op. Chem. Biol., 3:284-290 [1999]; Christians et al., Nat. Biotechnol., 17:259-264 [1999]; Crameri et al., Nature, 391:288-291 [1998]; Crameri, et al., Nat. Biotechnol., 15:436-438 [1997]; Zhang et al., Proc. Nat. Acad. Sci. U.S.A., 94:4504-4509 [1997]; Crameri et al., Nat. Biotechnol., 14:315-319 [1996]; Stemmer, Nature, 370:389-391 [1994]; Stemmer, Proc. Nat. Acad. Sci. USA, 91:10747-10751 [1994]; WO 95/22625; WO 97/0078; WO 97/35966; WO 98/27230; WO 00/42651; WO 01/75767; WO 2009/152336; and U.S. Pat. Appln. Publ. Nos. 2011/0082055, 2014/0005057, 2014/0214391, 2014/0221216, 2015/0133307, 2015/0134315, and 2015/0050658; all of which are incorporated herein by reference).

In some embodiments, the enzyme clones obtained following mutagenesis treatment are screened by subjecting the enzyme preparations to a defined temperature (or other assay conditions) and measuring the amount of enzyme activity remaining after heat treatments or other suitable assay conditions. Clones containing a polynucleotide encoding a LDC polypeptide are then isolated from the gene, sequenced to identify the nucleotide sequence changes (if any), and used to express the enzyme in a host cell. Measuring enzyme activity from the expression libraries can be performed using any suitable method known in the art (e.g., standard biochemistry techniques, such as HPLC analysis).

For engineered polypeptides of known sequence, the polynucleotides encoding the enzyme can be prepared by standard solid-phase methods, according to known synthetic methods. In some embodiments, fragments of up to about 100 bases can be individually synthesized, then joined (e.g., by enzymatic or chemical litigation methods, or polymerase mediated methods) to form any desired continuous sequence. For example, polynucleotides and oligonucleotides disclosed herein can be prepared by chemical synthesis using the classical phosphoramidite method (See e.g., Beaucage et al., Tet. Lett., 22:1859-69 [1981]; and Matthes et al., EMBO J., 3:801-05 [1984]), as it is typically practiced in automated synthetic methods. According to the phosphoramidite method, oligonucleotides are synthesized (e.g., in an automatic DNA synthesizer, purified, annealed, ligated and cloned in appropriate vectors).

Accordingly, in some embodiments, a method for preparing the engineered LDC polypeptide can comprise: (a) synthesizing a polynucleotide encoding a polypeptide comprising an amino acid sequence selected from the amino acid sequence of any variant as described herein, and (b) expressing the LDC polypeptide encoded by the polynucleotide. In some embodiments of the method, the amino acid sequence encoded by the polynucleotide can optionally have one or several (e.g., up to 3, 4, 5, or up to 10) amino acid residue deletions, insertions and/or substitutions. In some embodiments, the amino acid sequence has optionally 1-2, 1-3, 1-4, 1-5, 1-6, 1-7, 1-8, 1-9, 1-10, 1-15, 1-20, 1-21, 1-22, 1-23, 1-24, 1-25, 1-30, 1-35, 1-40, 1-45, or 1-50 amino acid residue deletions, insertions and/or substitutions. In some embodiments, the amino acid sequence has optionally 1, 2, 3, 4, 5, 6, 7, 8, 9, 10, 11, 12, 13, 14, 15, 16, 17, 18, 19, 20, 21, 22, 23, 24, 25, 30, 30, 35, 40, 45, or 50 amino acid residue deletions, insertions and/or substitutions. In some embodiments, the amino acid sequence has optionally 1, 2, 3, 4, 5, 6, 7, 8, 9, 10, 11, 12, 13, 14, 15, 16, 18, 20, 21, 22, 23, 24, or 25 amino acid residue deletions, insertions and/or substitutions. In some embodiments, the substitutions are conservative or non-conservative substitutions.

The expressed engineered LDC polypeptide can be evaluated for any desired improved property or combination of properties (e.g., activity, selectivity, stability, etc.) using any suitable assay known in the art, including but not limited to the assays and conditions described herein.

In some embodiments, any of the engineered LDC polypeptides expressed in a host cell are recovered from the cells and/or the culture medium using any one or more of the well-known techniques for protein purification, including, among others, lysozyme treatment, sonication, filtration, salting-out, ultra-centrifugation, and chromatography.

Chromatographic techniques for isolation of the LDC polypeptides include, among others, reverse phase chromatography, high-performance liquid chromatography, ion-exchange chromatography, hydrophobic-interaction chromatography, size-exclusion chromatography, gel electrophoresis, and affinity chromatography. Conditions for purifying a particular enzyme depends, in part, on factors such as net charge, hydrophobicity, hydrophilicity, molecular weight, molecular shape, etc., and will be apparent to those having skill in the art. In some embodiments, affinity techniques may be used to isolate the improved LDC enzymes. For affinity chromatography purification, any antibody that specifically binds a LDC polypeptide of interest may find use. For the production of antibodies, various host animals, including but not limited to rabbits, mice, rats, etc., are immunized by injection with a LDC polypeptide, or a fragment thereof. In some embodiments, the LDC polypeptide or fragment is attached to a suitable carrier, such as BSA, by means of a side chain functional group or linkers attached to a side chain functional group.

In some embodiments, the engineered LDC polypeptide is produced in a host cell by a method comprising culturing a host cell (e.g., an E. coli strain) comprising a polynucleotide sequence encoding an engineered LDC polypeptide as described herein under conditions conducive to the production of the engineered LDC polypeptide and recovering the engineered LDC polypeptide from the cells and/or culture medium. In some embodiments, the host cell produces more than one engineered LDC polypeptide.

In some embodiments, the present invention provides a method of producing an engineered LDC polypeptide comprising culturing a recombinant bacterial cell comprising a polynucleotide sequence encoding an engineered LDC polypeptide having at least 85%, 90%, 95%, 96%, 97%, 98%, or 99% sequence identity to reference sequences SEQ ID NO: 2, 4, 6, 8, 10, 12, 14, 38, 234, 284, 484, 594, 686, 688, and/or 766, and one or more amino acid residue differences as compared to SEQ ID NO: 2, 4, 6, 8, 10, 12, 14, 38, 234, 284, 484, 594, 686, 688, and/or 766, as provided herein, under suitable culture conditions to allow the production of the engineered LDC polypeptide and optionally recovering the engineered LDC polypeptide from the culture and/or cultured bacterial cells. In some embodiments, the host cell produces more than one engineered LDC polypeptide.

In some embodiments, once the engineered LDC polypeptides are recovered from the recombinant host cells and/or culture medium, they are further purified by any suitable method(s) known in the art. In some additional embodiments, the purified LDC polypeptides are combined with other ingredients and compounds to provide compositions and formulations comprising the engineered LDC polypeptide as appropriate for different applications and uses (e.g., pharmaceutical compositions).

Compositions:

The present invention provides engineered LDC polypeptides suitable for use in numerous compositions. These compositions find use in many fields, including but not limited to pharmaceuticals, dietary/nutritional supplements, food, feed, and fine chemical production. For example, in some embodiments, the present invention provides food and/or feeds comprising at least one engineered LDC variant and/or at least one polynucleotide sequence encoding at least one LDC variant. In some embodiments, the present invention provides beverages comprising at least one engineered LDC variant.

In some embodiments, the engineered LDC variant in food, feed, and/or nutritional/dietary supplement is glycosylated. Furthermore, the engineered LDC variants find use in any suitable edible enzyme delivery matrix. In some embodiments, the engineered LDC variants are present in an edible enzyme delivery matrix designed for rapid dispersal of the LDC variant within the digestive tract of an animal upon ingestion of the variant.

The present invention also provides engineered LDC polypeptides suitable for use in production of fine chemicals and other industrially important compounds (See e.g., US Pat. Appln. Nos. 2013/0340119, 2013/0005012, and 2005/0260724, and WO 2012/122333).

Pharmaceutical and Other Compositions:

The present invention provides engineered LDC polypeptides suitable for use in pharmaceutical and other compositions, such as dietary/nutritional supplements.

Depending on the mode of administration, these compositions comprising a therapeutically effective amount of an engineered LDC according to the invention are in the form of a solid, semi-solid, or liquid. In some embodiments, the compositions include other pharmaceutically acceptable components such as diluents, buffers, excipients, salts, emulsifiers, preservatives, stabilizers, fillers, and other ingredients. Details on techniques for formulation and administration are well known in the art and described in the literature.

In some embodiments, the engineered LDC polypeptides are formulated for use in oral pharmaceutical compositions. Any suitable format for use in delivering the engineered LDC polypeptides find use in the present invention, including but not limited to pills, tablets, gel tabs, capsules, lozenges, dragees, powders, soft gels, sol-gels, gels, emulsions, implants, patches, sprays, ointments, liniments, creams, pastes, jellies, paints, aerosols, chewing gums, demulcents, sticks, suspensions (including but not limited to oil-based suspensions, oil-in water emulsions, etc.), slurries, syrups, controlled release formulations, suppositories, etc. In some embodiments, the engineered LDC polypeptides are provided in a format suitable for injection (i.e., in an injectable formulation). In some embodiments, the engineered LDC polypeptides are provided in biocompatible matrices such as sol-gels, including silica-based (e.g., oxysilane) sol-gels. In some embodiments, the engineered LDC polypeptides are encapsulated. In some alternative embodiments, the engineered LDC polypeptides are encapsulated in nanostructures (e.g., nanotubes, nanotubules, nanocapsules, or microcapsules, microspheres, liposomes, etc.). Indeed, it is not intended that the present invention be limited to any particular delivery formulation and/or means of delivery. It is intended that the engineered LDC polypeptides be administered by any suitable means known in the art, including but not limited to parenteral, oral, topical, transdermal, intranasal, intraocular, intrathecal, via implants, etc.

In some embodiments, the engineered LDC polypeptides are chemically modified by glycosylation, pegylation (i.e., modified with polyethylene glycol [PEG] or activated PEG, etc.) or other compounds (See e.g., Ikeda, Amino Acids 29:283-287 [2005]; U.S. Pat. Nos. 7,531,341, 7,534,595, 7,560,263, and 7,553,653; US Pat. Appln. Publ. Nos. 2013/0039898, 2012/0177722, etc.). Indeed, it is not intended that the present invention be limited to any particular delivery method and/or mechanism.

In some additional embodiments, the engineered LDC polypeptides are provided in formulations comprising matrix-stabilized enzyme crystals. In some embodiments, the formulation comprises a cross-linked crystalline engineered LDC enzyme and a polymer with a reactive moiety that adheres to the enzyme crystals. The present invention also provides engineered LDC polypeptides in polymers.

In some embodiments, compositions comprising the engineered LDC polypeptides of the present invention include one or more commonly used carrier compounds, including but not limited to sugars (e.g., lactose, sucrose, mannitol, and/or sorbitol), starches (e.g., corn, wheat, rice, potato, or other plant starch), cellulose (e.g., methyl cellulose, hydroxypropylmethyl cellulose, sodium carboxy-methylcellulose), gums (e.g., arabic, tragacanth, guar, etc.), and/or proteins (e.g., gelatin, collagen, etc.). Additional components in oral formulations may include coloring and or sweetening agents (e.g., glucose, sucrose, and mannitol) and lubricating agents (e.g., magnesium stearate), as well as enteric coatings (e.g., methacrylate polymers, hydroxyl propyl methyl cellulose phthalate, and/or any other suitable enteric coating known in the art). In some embodiments, disintegrating or solubilizing agents are included (e.g., cross-linked polyvinyl pyrrolidone, agar, alginic acid or salts thereof, such as sodium alginate). In some embodiments, the engineered LDC polypeptide are combined with various additional components, including but not limited to preservatives, suspending agents, thickening agents, wetting agents, alcohols, fatty acids, and/or emulsifiers, particularly in liquid formulations.

In some embodiments, the engineered LDC polypeptide are be combined with various additional components, including but not limited to preservatives, suspending agents, thickening agents, wetting agents, alcohols, fatty acids, and/or emulsifiers, particularly in liquid formulations. In some embodiments, the engineered LDC polypeptides are administered to subjects in combination with other compounds used in the treatment of MSUD, as well as any other suitable compounds.

In some embodiments, the present invention provides engineered LDC polypeptides suitable for use in decreasing, ameliorating, or eliminating the signs and/or symptoms of MSUD. The dosage of engineered LDC polypeptide(s) administered to a patient depends upon the genotype of the patient, the general condition of the patient, and other factors known to those in the art. In some embodiments, the compositions are intended for single or repeat administration to a patient. In some embodiments, it is contemplated that the concentration of engineered LDC polypeptide(s) in the composition(s) administered to a patient is sufficient to effectively treat, ameliorate and/or prevent the symptoms of the disease. In some embodiments, the engineered LDC polypeptides are administered in combination with other pharmaceutical and/or dietary compositions.

Industrial Compositions:

It is contemplated that the engineered LDC polypeptides of the present invention will find use in industrial compositions, including such areas as food flavorings (e.g., cheese).

In some embodiments, the engineered LDC polypeptides are formulated for use in the food and/or feed industries. In some embodiments, the engineered LDC polypeptides are formulated in granulated or pelleted products which are mixed with animal feed components such as additional enzymes (for example, cellulases, laccases, and amylases). In some alternative embodiments, the engineered LDC polypeptides are used in liquid animal feed compositions (e.g., aqueous or oil-based slurries). Thus, in some embodiments, the engineered LDC variants of the present invention are sufficiently thermotolerant and thermostable to withstand the treatment used to produce pellets and other processed feed/foods.

The foregoing and other aspects of the invention may be better understood in connection with the following non-limiting examples. The examples are provided for illustrative purposes only and are not intended to limit the scope of the present invention in any way.

EXPERIMENTAL

The following Examples, including experiments and results achieved, are provided for illustrative purposes only and are not to be construed as limiting the present invention.

In the experimental disclosure below, the following abbreviations apply: ppm (parts per million); M (molar); mM (millimolar), uM and µM (micromolar); nM (nanomolar); mol (moles); gm and g (gram); mg (milligrams); ug and µg (micrograms); L and l (liter); ml and mL (milliliter); cm (centimeters); mm (millimeters); um and µm (micrometers); sec. (seconds); min(s) (minute(s)); h(s) and hr(s) (hour(s)); U (units); MW (molecular weight); rpm (rotations per minute); psi and PSI (pounds per square inch); ° C. (degrees Centigrade); RT and rt (room temperature); CDS (coding sequence); DNA (deoxyribonucleic acid); RNA (ribonucleic acid); AUC (area under the curve); E. coli W3110 (commonly used laboratory E. coli strain, available from the Coli Genetic Stock Center [CGSC], New Haven, CT); iMSUD (Intermediate Maple Syrup Urine Disease); HTP (high throughput); HPLC (high pressure liquid chromatography); LC (liquid chromatography); MS (mass spectroscopy); LC-MS/MS (liquid chromatography with two mass spectrometers); SPE (solid phase extraction); KIC (ketoisocaproate); IPTG (isopropyl β-D-1-thiogalactopyranoside); PLP (pyridoxal 5'-phosphate); BSA (bovine serum albumin); BW (body weight); MSUD (maple syrup urine disease); FIOPC (fold improvements over positive control); LB (Luria broth); TB (Terrific broth); Innovative Research (Innovative Research, Novi, MI); Microfluidics (Microfluidics Corp., Newton, MA); Thermotron (Thermotron, Holland, MI); Waters (Waters Corp., Milford, MA); Infors (Infors AG, Bottmingen, Switzerland); Cambridge Isotope Laboratories (Cambridge Isotope Laboratories, Inc., Tewksbury, MA); Sigma-Aldrich (Sigma-Aldrich, St. Louis, MO); Applied Biosystems (Applied Biosystems, part of Life Technologies, Corp., Grand Island, NY), Agilent (Agilent Technologies, Inc., Santa Clara, CA); Thermo Scientific (part of Thermo Fisher Scientific, Waltham, MA); Gibco (Gibco part of Thermo Fisher Scientific, Waltham, MA); Khuner (Khuner Shaker, Inc., Santa Clara, CA); BN Labs (British Nutritions, LLC, Irvine, CA); GraphPad Software (GraphPad Software, San Diego, CA); and Corning (Corning, Inc., Palo Alto, CA).

Example 1

Synthesis and Assaying of Amino Acid Decarboxylase Enzymes with Leucine Decarboxylase Activity In this Example, methods used in the synthesis and assaying of amino acid decarboxylase enzymes for leucine decarboxylase (LDC) activity are described.

Amino Acid Decarboxylase Gene Acquisition and Construction of Expression Vectors Polynucleotide sequences encoding amino acid decarboxylases from Streptomyces sp. GP55 (SEQ ID NO: 2; Acc. No. WP_101384472.1), Saccharothrix sp. ST-888 (SEQ ID NO: 4; Acc. No. WP_052681825.1), and Kitasatospora sp. MBT63 (SEQ ID NO: 6; Acc. No. WP_051812394.1), Kitasatospora sp. MMS61-BH015 (SEQ ID NO: 8; Acc. No. WP_104818078.1), Streptomyces sp. NRRL F-6131 (SEQ ID NO: 10; Acc. No. WP_051769113.1), Planctomycetaceae bacterium (SEQ ID NO: 12; Acc. No. RPI63066.1), and Larkinella arboricola (SEQ ID NO: 14; Acc. No. A0A327WPB0) were synthesized as the genes of SEQ ID NOS: 1, 3, 5, 7, 9, 11, and 13, respectively. These synthetic genes were cloned into a pCK110900 vector system (See e.g., U.S. Pat. No. 7,629,157 and US Pat. Appln. Publn. No. 2016/0244787, both of which are hereby incorporated by reference), and subsequently expressed in an E. coli strain derived from W3110. In some embodiments, expression vectors lacking antimicrobial resistance markers find use.

Production of Shake Flask Powders (SFP)

E. coli cultures transformed with plasmids containing amino acid decarboxylases were plated onto Luria Broth-agar plates with 1% glucose and in some instances, 30 µg/mL chloramphenicol, and grown overnight at 37° C. A single colony from each culture was transferred to 5 mL of Luria Broth (LB) with 1% glucose and 30 µg/mL chloramphenicol, where appropriate. The cultures were grown for 18 h at 30° C., 250 rpm, and subcultured approximately 1:50 into 250 ml of Terrific Broth (TB) with 30 µg/mL of chloramphenicol. The cultures were grown for approximately 3-4 h at 30° C., 250 rpm, to an $OD_{600}$ of 0.6-0.8 and induced with 1 mM of IPTG. The cultures were grown for 20 h at 30° C., 250 rpm. Cells were harvested by centrifugation (7000 rpm×10 min, 4° C.), and the supernatant was discarded. The pellets were resuspended in 30 mL of 50 mM sodium phosphate, pH 7.0, with 1 mM PLP and lysed using a single pass through a microfluidizer (Microfluidics) at 110 psi. The lysate was pelleted (10,000×rpm, 30 min, 4° C.), and the resulting supernatant was frozen and lyophilized to generate a powder containing the expressed enzyme.

SFP Characterization Assay for Decarboxylase Activity on Leucine at Different pH Shake flask powders were reconstituted to provide 40 g/L powder and were serially diluted to 2.5-40 g/L. Then, 25 µL of these stocks were added to 75 µL of reaction mix for a final concentration of 10 mM leucine and 0.1 mM PLP in 50 mM sodium phosphate, pH 7.0, or Mellvaine buffer, pH 4.6. Reactions were incubated for 3-4 h at 37° C. at 250 rpm in a THERMOTRON® titre-plate shaker before being quenched with 3 volumes of acetonitrile with 0.1% formic acid. The resulting samples were centrifuged for 10 min at 4° C. at 4000 rpm before the supernatant was analyzed by LC-MS/MS for isopentylamine, the decarboxylation product of leucine. Example LC-MS/MS instrument and parameters are shown in Table 1-1, and results for SEQ ID NOS: 2-14 are shown in Table 1-2.

TABLE 1-1

HPLC-MS/MS Analysis of Isopentylamine

| | |
|---|---|
| Instrument | Agilent HPLC 1200 series, Sciex 4000 QTrap |
| Column | ZORBAX ® Eclipse Plus C18, 4.6 × 50 mm, 1.8 µm with ZORBAX ® Eclipse Plus C18, 4.6 × 5 mm, 1.8 µm guard column (Agilent) |
| Mobile phase | Gradient (A: 0.1% formic acid in water, B: 0.1% formic acid in acetonitrile) |
| | Time (m) % B |
| | 0 80 |
| | 0.50 60 |
| | 2.00 60 |
| | 2.20 5 |
| | 2.60 5 |
| | 2.80 80 |
| | 3.20 80 |
| Flow rate | 0.5 mL/m |
| Run time | 3.2 m |
| Peak retention times | Isopentylamine: 0.99 m |
| Column temperature | 40° C. |
| Injection volume | 10 µL |
| MS detection | MRM 88.1/77.1 (for isopentylamine) |
| MS conditions | MODE: MRM; CUR: 20; IS: 4500; CAD: med; TEM: 550° C.; GS1: 40; GS2: 40; DP: 61; EP: 10; CXP: 3; DT: 100 ms for each transition; CE: 11. |

SFP Characterization Assay for pH Tolerance

To evaluate the relative tolerance of enzymes to acidic pH, SFPs were reconstituted to provide 20 g/L powder and were diluted 2-fold into McIlvaine buffer, pH 2.8-8.0. The mixture was incubated for 1.5 h at 37° C. at 250 rpm in a THERMOTRON® titre-plate shaker. After incubation, 20 µL of the enzyme solutions were added to 90 µL of reaction mix for a final concentration of 5 mM leucine in 50 mM sodium phosphate, pH 7.0. Reactions were incubated for 2 h at 37° C. at 250 rpm in a THERMOTRON® titre-plate shaker before being diluted 2-fold in water and quenched with 3 volumes of acetonitrile with 0.1% formic acid. The resulting samples were processed as described above, and the supernatant was analyzed by LC-MS/MS for isopentylamine. The results obtained for SEQ ID NOS: 2-14 are shown in Table 1-2.

SFP Characterization Assay for Thermostability

Improved thermostability is a valuable trait useful in manufacture and storage of enzyme therapeutics and often occurs as a byproduct of other stabilization efforts. To assess the relative stability of the variants produced during the development of the present invention, the thermostability of the enzymes was assessed as follows: 100 µL of amino acid decarboxylase SFP at 10 g/L were incubated for 1.5 h at 30-70° C. in a thermocycler. After incubation, samples were briefly centrifuged, and 10 µL of the heat-treated SFP was added to 90 µL of reaction mix for a final concentration of 5 mM leucine in 50 mM sodium phosphate, pH 7.0. Reactions were incubated for 2 h at 37° C. at 250 rpm in a THERMOTRON® titre-plate and processed and analyzed by LC-MS/MS as described above. Results for SEQ ID NOS: 2-14 are shown in Table 1-2.

SFP Characterization Assay for Resistance to Proteases

To evaluate the relative stability of enzymes to representative intestinal proteases, a mix of porcine trypsin (Sigma Aldrich) and bovine chymotrypsin (Sigma Aldrich) was dissolved in 50 mM sodium phosphate, pH 7.0, to a concentration of 3 g/L each and serially diluted 2-fold. Then, 10 g/L amino acid decarboxylase SFP were incubated with 0-1.5 g/L trypsin/chymotrypsin at 37° C. for 1 h at 250 rpm in a THERMOTRON® titre-plate shaker. After incubation, 10 µL of the protease-treated SFP was added to 90 µL of reaction mix for a final concentration of 3 mM leucine in 50 mM sodium phosphate, pH 7.0. Reactions were incubated for 1 h at 37° C. at 250 rpm in a THERMOTRON® titre-plate before being diluted 5-fold in water and quenched with 3 volumes of acetonitrile with 0.1% formic acid. The resulting samples were processed as described above, and the supernatant was analyzed by LC-MS/MS as described above. Results for SEQ ID NOS: 2 and 12 are shown in Table 1-2.

TABLE 1-2

Activity of Wild-Type Amino Acid Decarboxylases Tested Under Various Conditions[1]

| SEQ NO: ID (nt/aa) | pH 7 Activity | pH 4.6 Activity | pH Stability (% Residual Activity at pH 4) | Thermostability (% Residual Activity at 50° C.) | Protease Stability (% Residual Activity After 0.25 g/L Protease) |
|---|---|---|---|---|---|
| 1/2 | +++ | +++ | +++ | +++ | ++ |
| 3/4 | +++ | + | ++++ | ++ | |
| 5/6 | +++ | ++ | ++ | +++ | |
| 7/8 | ++ | + | ++ | +++ | |
| 9/10 | +++ | + | ++ | ++ | |
| 11/12 | +++ | +++ | ++ | ++++ | ++ |
| 13/14 | +++ | ++ | + | +++ | |

[1]The pH 4 and pH 7 activities were determined in units of isopentylamine peak area and are as follows: "+" = 2.5E05-5E05; "++" >5E05; and "+++" >1E06. The pH stability, thermostability, and protease stability are represented as % residual activity with values defined as: "+" = 1-10%; "++" >10%; "+++" >50%; and "++++" >80%.

Example 2

LDC Variants of SEQ ID NO: 12

In this Example, experiments for evolution and screening of LDC variants derived from SEQ ID NO: 12, for improved leucine activity, low pH tolerance, and protease resistance are described. Directed evolution of the LDC encoded by SEQ ID NO: 11, was carried out by constructing libraries of variant genes. These libraries were then plated, grown, and screened using the methods described below.

High-Throughput (HTP) Growth of Cultures Expressing LDC Enzymes

Transformed E. coli cells were selected by plating onto LB agar plates containing 1% glucose. After overnight incubation at 37° C., colonies were picked onto NUNC™ (Thermo-Scientific) 96-well shallow flat bottom plates filled with 180 L/well LB-medium supplemented with 1% glucose. Cultures were allowed to grow overnight for 18-20 hours in a Kuhner shaker (200 rpm, 30° C., and 85% relative humidity). Overnight growth samples (20 µL) were transferred into COSTAR® 96-well deep plates (Corning) filled with 380 µL of TB. Cultures were incubated for 2-3 hours in a Kuhner shaker (250 rpm, 30° C., and 85% relative humidity) and then induced with 40 µL of 10 mM IPTG in sterile water and incubated overnight for 20-24 hours in a Kuhner shaker (250 rpm, 30° C., and 85% relative humidity). Cells were pelleted (4000 rpm×10 min), supernatants were discarded, and cells were frozen at −80° C. prior to analysis.

Lysis of HTP Cell Pellets

E. coli cell pellets were lysed with 400 μL of lysis buffer (1 mg/ml lysozyme+0.5 g/L PMBS in 50 mM sodium phosphate pH 7). The mixture was agitated for 1.5 h at room temperature and pelleted (4000 rpm×10 min) after which the clarified lysates were preincubated for 1 h at 60° C. in a THERMOTRON® titre-plate shaker (400 rpm). The heat-treated lysates were pelleted (4000 rpm×10 min), and the supernatants were used in HTP assays.

HTP Activity Analysis of Clarified Lysates Pretreated with Acidic Buffer and Protease Heat-treated lysates containing LDC variants were challenged with acidic buffer to simulate the gastric environment. First, heat-treated clarified lysate was preincubated 1:1 with McIlvaine buffer, pH 3.6, in COSTAR® 96-well round bottom plates (Corning). The plates were sealed and incubated for 1 h at 37° C. in a THERMOTRON® titre-plate shaker (250 rpm). Subsequently, the resulting acidic buffer-treated lysate was preincubated 1:1 with a final concentration of 0.02 g/L trypsin and chymotrypsin (1:1) for 1 h at 37° C. with shaking. After incubation, the resulting samples were centrifuged, and 50 μL of sample was added to 50 μL of reaction mix for a final concentration of 3 mM leucine and 10 UM PLP in 50 mM sodium phosphate, pH 7.0. In some experiments, reaction mix resulting in a final concentration of 0.6-3 mM of all twenty amino acids, with isoleucine-$d_{10}$ (Cambridge Isotope Laboratories) in place of isoleucine, and 10 UM PLP in 50 mM sodium phosphate, pH 7.0, was used. Reactions were incubated for 1 h at 37° C. at 250 rpm in a THERMOTRON® titre-plate before being quenched with 3 volumes of acetonitrile with 0.1% formic acid, centrifuged for 10 min at 4° C. at 4000 rpm, and diluted 50-fold in water. The resulting samples were analyzed by LC-MS/MS as described in Example 1. The results of these assays are shown in Table 2-1.

TABLE 2-1

Relative Activity of LeuDC Variants Tested Under Various Conditions (Relative to SEQ ID NO: 12)[1]

| SEQ ID NO: (nt/aa) | Amino Acid Differences (Relative to SEQ ID NO: 12) | Leu FIOP (Relative to SEQ ID NO: 12) | AA Mix FIOP (Relative to SEQ ID NO: 12) |
|---|---|---|---|
| 15/16 | I34L/C38V/T39N/T127S/I245M/N350E/I357V | +++ | ++ |
| 17/18 | T39N/T102S/I264V/T275S/I357V | +++ | +++ |
| 19/20 | I34L/C38V/T39N/T102S/T275S/I357V | +++ | ++ |
| 21/22 | T39N/I245M/I264V/V267I/T275S/I357V | +++ | ++ |
| 23/24 | C38V/T39N/T127S/I264V/T275S | +++ | ++ |
| 25/26 | T39N/T127S/I245M/I357V | +++ | ++ |
| 27/28 | I34L/T39N/T275S/V349T/N350E/I357V | ++++ | ++ |
| 29/30 | T39N/T127S/I245M/I264V/T275S/N350E/I357V | ++++ | ++ |
| 31/32 | C38V/T39N/T102S/T127S/I264V/V267I/N350E/I357V | ++++ | +++ |
| 33/34 | T39N/T275S/N350E/I357V | ++++ | ++ |
| 35/36 | C38V/T39N/I245M/T275S/I357V | +++ | ++ |
| 37/38 | H14T/T39N/T102S/T127S/I245M/V267I/T275S/V349T/N350E | ++++ | ++ |
| 39/40 | H14T/I34L/C38V/T39N/T102S/V267I/T275S/N350E/I357V | + | +++ |
| 41/42 | C38V/T39N/I264V/V267I/T275S/N350E | +++ | ++ |
| 43/44 | C38V/T39N/T127S/I264V/N350E/I357V | +++ | ++ |
| 45/46 | C38V/T39N/T102S/T127S/N350E | +++ | ++ |
| 47/48 | I34L/C38V/T39N/T102S/T127S/T275S/I357V | +++ | +++ |
| 49/50 | T39N/T102S/T127S/I264V/T275S/I357V | +++ | +++ |
| 51/52 | C38V/T39N/T127S/N350E/I357V | ++++ | ++ |
| 53/54 | I34L/T39N/T102S/T127S/I264V/T275S/I357V | +++ | ++ |
| 55/56 | C38V/T39N/T275S/N350E | +++ | ++ |
| 57/58 | C38V/T39N/T127S/I245M/V267I/I357V | +++ | ++ |
| 59/60 | C38V/T39N/T102S/T127S/V267I/T275S/V349T/N350E/I357V | ++++ | +++ |
| 61/62 | C38V/T39N/T275S | +++ | ++ |
| 63/64 | T39N/T127S/V267I/T275S/N350E/I357V | +++ | ++ |
| 65/66 | T39N/T127S/V267I/N350E/I357V | +++ | ++ |
| 67/68 | I34L/C38V/T39N/T127S/I245M/V349T/N350E/I357V | +++ | ++ |
| 69/70 | I34L/T39N/T102S/T127S/T275S/V349T/I357V | +++ | ++ |
| 71/72 | C38V/T39N/T127S/I357V | +++ | ++ |
| 73/74 | I34L/T39N/T102S/I264V/T275S/N350E/I357V | +++ | ++ |
| 75/76 | C38V/T39N/T102S/T127S/N350E/I357V | ++++ | +++ |
| 77/78 | C38V/T39N/T102S/T127S/V349T/N350E/I357V | ++++ | ++ |
| 79/80 | T39N/I264V/V267I/T275S/N350E | ++++ | ++ |
| 81/82 | T39N/T127S/I357V | +++ | ++ |
| 83/84 | T39N/T127S/I245M/I264V/V267I/T275S/N350E | ++++ | ++ |
| 85/86 | C38V/T39N/I264V/T275S/I357V | +++ | ++ |
| 87/88 | T39N/T102S/V267I/T275S/I357V | +++ | ++ |
| 89/90 | R395D | ++ | ++ |
| 91/92 | T397A | ++ | ++ |
| 93/94 | T39S | ++ | ++ |
| 95/96 | P398* | ++ | ++ |
| 97/98 | K389G | ++ | ++ |
| 99/100 | K389Q | ++ | + |
| 101/102 | L48F | ++ | ++ |
| 103/104 | T405L | ++ | + |
| 105/106 | A391* | ++ | ++ |
| 107/108 | H343E | ++ | ++ |
| 109/110 | K393T | ++ | ++ |
| 111/112 | K299A | ++ | ++ |
| 113/114 | H14I | ++ | + |
| 115/116 | K394E | ++ | + |
| 117/118 | A391E | ++ | ++ |
| 119/120 | K196R | ++ | ++ |
| 121/122 | H255G | ++ | + |
| 123/124 | K5M | ++ | + |
| 125/126 | K196D | ++ | ++ |
| 127/128 | R395K | ++ | ++ |
| 129/130 | H343A | ++ | + |
| 131/132 | R324M | ++ | ++ |
| 133/134 | R353E | ++ | + |
| 135/136 | L364R | ++ | ++ |
| 137/138 | K389E | ++ | + |
| 139/140 | N350S | ++ | + |
| 141/142 | I164C | ++ | + |
| 143/144 | R395A | ++ | ++ |
| 145/146 | H255P | ++ | ++ |
| 147/148 | I164A | ++ | ++ |
| 149/150 | K389P | + | + |
| 151/152 | K379D | ++ | ++ |
| 153/154 | H255N | + | + |
| 155/156 | Q365E | ++ | ++ |
| 157/158 | Q339D | ++ | ++ |
| 159/160 | T405H | ++ | ++ |
| 161/162 | A381D | ++ | ++ |

TABLE 2-1-continued

Relative Activity of LeuDC Variants Tested Under Various Conditions (Relative to SEQ ID NO: 12)[1]

| SEQ ID NO: (nt/aa) | Amino Acid Differences (Relative to SEQ ID NO: 12) | Leu FIOP (Relative to SEQ ID NO: 12) | AA Mix FIOP (Relative to SEQ ID NO: 12) |
|---|---|---|---|
| 163/164 | I357C | ++ | + |
| 165/166 | T405E | ++ | + |
| 167/168 | T405D | ++ | ++ |
| 169/170 | R353W | ++ | ++ |
| 171/172 | R324T | ++ | ++ |
| 173/174 | A381E | ++ | + |
| 175/176 | N139G | + | ++ |
| 177/178 | K299V | + | ++ |
| 179/180 | K379P | + | ++ |
| 181/182 | Q339A | ++ | ++ |
| 183/184 | R324S | ++ | ++ |
| 185/186 | R353D | ++ | ++ |
| 187/188 | L364K | ++ | ++ |
| 189/190 | R395G | ++ | ++ |
| 191/192 | R353S | ++ | + |
| 193/194 | R395S | ++ | + |
| 195/196 | I357M | ++ | + |
| 197/198 | D386* | ++ | ++ |
| 199/200 | R353N | ++ | ++ |
| 201/202 | R353L | ++ | + |
| 203/204 | R318K | ++ | ++ |

[1]All activities were determined relative to the reference polypeptide of SEQ ID NO: 12. Levels of increased activity are defined as follows: "+" = 0.9 to 1.1; "++" >1.1; "+++" >3; and "++++" >5.

Example 3

LDC Variants of SEQ ID NO: 38

In this Example, experiments for evolution and screening of LDC variants derived from SEQ ID NO: 38, for improved leucine activity, low pH tolerance, and protease resistance are described. Directed evolution of the LDC encoded by SEQ ID NO: 38, was carried out by constructing libraries of variant genes. These libraries were then plated, grown, and screened using the methods described below.

HTP Activity Analysis of Clarified Lysates Pretreated with Acidic Buffer and Protease HTP growth and lysis of *E. coli* cells expressing LDC variants were performed as described in Example 2. Heat-treated lysates containing LDC variants were challenged with acidic buffer as described in Example 2. Subsequently, the acidic buffer-treated lysate was preincubated 1:1 with a final concentration of 0.1 g/L trypsin and chymotrypsin (1:1) for 1 h at 37° C. with shaking. After incubation, samples were centrifuged, and 50 μL of sample was added to 50 μL of reaction mix for a final concentration of 3 mM leucine and 10 μM PLP in 50 mM sodium phosphate, pH 7.0. In some experiments, reaction mix resulting in a final concentration of 0.6-3 mM of all twenty amino acids, with isoleucine-$d_{10}$ (Cambridge Isotope Laboratories) in place of isoleucine, and 10 UM PLP in 50 mM sodium phosphate, pH 7.0, was used. Reactions were incubated for 1 h at 37° C. at 250 rpm in a THERMOTRON® titre-plate before being quenched with 3 volumes of acetonitrile with 0.1% formic acid, centrifuged for 10 min at 4° C. at 4000 rpm, and diluted 50-fold in water. The resulting samples were analyzed by LC-MS/MS as described in Example 1 or by RAPIDFIRE® mass spectrometry (Agilent) using the parameters shown in Table 3-1. The results of these assays are shown in Table 3-2.

TABLE 3-1

Agilent RAPIDFIRE® SPE-MS/MS Conditions for Isopentylamine Detection

| | |
|---|---|
| Buffer A | 0.1% formic acid in LC-MS grade water; 1.5 mL/min flow rate (Pump 1) |
| Buffer B | 100% LC-MS grade acetonitrile; 1.25 mL/min flow rate (Pumps 2 & 3) |
| Aqueous wash | Water |
| Organic wash | Acetonitrile |
| SPE cartridge | Agilent RAPIDFIRE® cartridge D (Hypercarb) |
| RF state 1 | 600 ms |
| RF state 2 | 3000 ms |
| RF state 3 | 0 |
| RF state 4 | 6000 ms |
| RF state 5 | 1000 ms |

Agilent Jet Stream Source Parameters

| | |
|---|---|
| Drying gas temperature | 225° C. |
| Drying gas flow | 9 L/min |
| Nebulizer pressure | 40 ps |
| Sheath gas temperature | 200° C. |
| Sheath gas flow | 8 L/min |
| Capillary voltage | +1500 V |
| Nozzle voltage | +1000 V |

Agilent 6470 Triple Quadrupole MRM Parameters

| Compound | Q1 | Q3 | Dwell | Fragmentor | CE | CAV |
|---|---|---|---|---|---|---|
| Isopentylamine | 88.1 | 43.3 | 165 | 50 | 12 | 4 |
| Isopentylamine | 88.1 | 71.2 | 165 | 50 | 6 | 4 |

TABLE 3-2

Relative Activity of LeuDC Variants Tested Under Various Conditions (Relative to SEQ ID NO: 38)[1]

| SEQ ID NO: (nt/aa) | Amino Acid Differences (Relative to SEQ ID NO: 38) | Leu FIOP (Relative to SEQ ID NO: 38) | AA Mix FIOP (Relative to SEQ ID NO: 38) |
|---|---|---|---|
| 205/206 | I164A/R324M/I357C/L364K | ++ | +++ |
| 207/208 | I164A/R353W/I357C/L364R | ++ | +++ |
| 209/210 | A64E/R318K/R324S/I357V/L364R | ++ | +++ |
| 211/212 | R318K/H343E/I357M | ++ | +++ |
| 213/214 | R324N/R353W/I357C/L364K | ++ | +++ |
| 215/216 | L48F/A64E/I357M/L364K | ++ | +++ |
| 217/218 | A64E/R324M/R353N/I357C/L364R | ++ | ++ |
| 219/220 | I164C/R353W/I357C/L364R | ++ | +++ |
| 221/222 | A64E/I164C/R353D/I357V | ++ | +++ |

TABLE 3-2-continued

Relative Activity of LeuDC Variants Tested Under Various Conditions
(Relative to SEQ ID NO: 38)[1]

| SEQ ID NO: (nt/aa) | Amino Acid Differences (Relative to SEQ ID NO: 38) | Leu FIOP (Relative to SEQ ID NO: 38) | AA Mix FIOP (Relative to SEQ ID NO: 38) |
|---|---|---|---|
| 223/224 | I164C/R324M/H343E/R353D/I357V/L364R | ++ | +++ |
| 225/226 | R318K/H343E/I357C | ++ | ++ |
| 227/228 | I164A/L364R | ++ | +++ |
| 229/230 | L48F/A64E/I164A/R324M/H343E/L364R | ++ | +++ |
| 231/232 | I164C/R318K/R324S/I357V/L364R | +++ | ++++ |
| 233/234 | I164A/R324M/H343E/R353D/I357C/L364R | ++ | ++++ |
| 235/236 | L48F/A64E/I164A/R324M/H343E/R353E/I357C/L364K | ++ | +++ |
| 237/238 | R324M/I357M/L364R | ++ | +++ |
| 239/240 | I164A/R318K/R324M/H343E/R353E/I357C | ++ | +++ |
| 241/242 | I164C/R353D/I357V/L364R | ++ | ++++ |
| 243/244 | A64E/I164A/R324M/H343E/R353D/I357V/L364K | ++ | ++++ |
| 245/246 | L48F/A64E/I164C/R353N/I357V/L364R | ++ | +++ |
| 247/248 | R324M/H343E/I357E/L364K | ++ | +++ |
| 249/250 | I164C/R353D/I357V/L364K | ++ | +++ |
| 251/252 | I357V/L364R | ++ | +++ |
| 253/254 | I164A/K196D/R324M/I357C/L364K | ++ | +++ |
| 255/256 | K196D/R318K/R324M/R353N/I357C/L364K | ++ | +++ |
| 257/258 | A64E/I164A/R324M/H343E/I357C/L364R | ++ | +++ |
| 259/260 | K389G/K394E/R395D/T397A/T405D | +++ | +++ |
| 261/262 | Y132F/H255P/Q339A/K379D/R395D | ++ | ++ |
| 263/264 | K379D/D386* | ++ | +++ |
| 265/266 | Q339A/A391* | ++ | ++ |
| 267/268 | Q339A/K389G/R395K | ++ | ++ |
| 269/270 | K379D/K394E/R395D/T397A/R404I/T405H | ++ | ++ |
| 271/272 | K379D/K394E/R395K/T397A/T405D | ++ | ++ |
| 273/274 | Q339A/K394E/R395K/T405D | ++ | ++ |
| 275/276 | K394E/T397A | ++ | ++ |
| 277/278 | Q339A/K379D/K389G/K394E/R395D | ++ | +++ |

[1]All activities were determined relative to the reference polypeptide of SEQ ID NO: 38. Levels of increased activity are defined as follows: "+" = 0.9 to 1.1; "++" > 1.1; "+++" > 1.5; and "++++" > 2.

Example 4

LDC Variants of SEQ ID NO: 234

In this Example, experiments for evolution and screening of LDC variants derived from SEQ ID NO: 234, for improved leucine activity, low pH tolerance, and protease resistance are described. Directed evolution of the LDC encoded by SEQ ID NO: 234, was carried out by constructing libraries of variant genes. These libraries were then plated, grown, and screened using the methods described below.

HTP Activity Analysis of Clarified Lysates Pretreated with Acidic Buffer and Protease HTP growth and lysis of *E. coli* cells expressing LDC variants were performed as described in Example 2. Heat-treated lysates containing LDC variants were challenged with acidic buffer as described in Example 2, with the following conditions: heat-treated clarified lysate was pre-incubated 1:1 with McIlvaine buffer, pH 3.3. The resulting acidic buffer-treated lysate was then preincubated 1:1 with a final concentration of 0.5 g/L trypsin and chymotrypsin (1:1) for 1 h at 37° C. with shaking. After incubation, samples were centrifuged, and 40 L of sample was added to 60 µL of reaction mix for a final concentration of 3 mM leucine and 10 µM PLP in 50 mM sodium phosphate, pH 7.0. In some experiments, reaction mix resulting in a final concentration of 0.6-3 mM of all twenty amino acids, with isoleucine-$d_{10}$ (Cambridge Isotope Laboratories) in place of isoleucine, and 10 µM PLP in 50 mM sodium phosphate, pH 7.0, was used. Reactions were incubated for 1 h at 37° C. at 250 rpm in a THERMOTRON® titre-plate before being quenched with 3 volumes of acetonitrile with 0.1% formic acid, centrifuged for 10 min at 4° C. at 4000 rpm, and diluted 10 or 500-fold in water. The resulting samples were analyzed by LC-MS/MS as described in Example 1 or by RAPIDFIRE®-MS as described in Example 3.

TABLE 4-1

Relative Activity of LeuDC Variants Tested Under Various Conditions
(Relative to SEQ ID NO: 234)[1]

| SEQ ID NO: (nt/aa) | Amino Acid Differences (Relative to SEQ ID NO: 234) | Leu FIOP (Relative to SEQ ID NO: 234) | AA Mix FIOP (Relative to SEQ ID NO: 234) |
|---|---|---|---|
| 279/280 | R318K/Q339A/K379D | ++ | ++ |
| 281/282 | A64E/H255P | ++ | + |
| 283/284 | L48F/A64E/H255P | ++ | + |
| 285/286 | H255P | ++ | ++ |
| 287/288 | T405H | ++ | ++ |
| 289/290 | H255P/R318K/K379D | ++ | ++ |
| 291/292 | L48F/H255P/K379D | ++ | ++ |
| 293/294 | A64E | ++ | + |
| 295/296 | Q339A | ++ | + |
| 297/298 | L48F/H255P/Q339A | ++ | + |
| 299/300 | G2E | ++ | ++ |
| 301/302 | A380E | ++ | + |
| 303/304 | S340V | ++ | + |
| 305/306 | A382S | ++ | + |
| 307/308 | P390A | ++ | + |
| 309/310 | T161V | ++ | ++ |
| 311/312 | A64S | ++ | ++ |
| 313/314 | M193I | ++ | ++ |
| 315/316 | V69I | ++ | ++ |
| 317/318 | S340T | ++ | + |
| 319/320 | S263V | ++ | ++ |

TABLE 4-1-continued

Relative Activity of LeuDC Variants Tested Under Various Conditions
(Relative to SEQ ID NO: 234)[1]

| SEQ ID NO: (nt/aa) | Amino Acid Differences (Relative to SEQ ID NO: 234) | Leu FIOP (Relative to SEQ ID NO: 234) | AA Mix FIOP (Relative to SEQ ID NO: 234) |
|---|---|---|---|
| 321/322 | P390E | ++ | ++ |
| 323/324 | N3M | ++ | ++ |
| 325/326 | P390* | ++ | ++ |
| 327/328 | P390S | ++ | + |
| 329/330 | A401* | ++ | ++ |
| 331/332 | S263T | ++ | ++ |
| 333/334 | A401Y | ++ | + |
| 335/336 | F33L | ++ | ++ |
| 337/338 | R259L | ++ | ++ |
| 339/340 | R395D/T397A | ++ | ++ |
| 341/342 | K394E | ++ | ++ |
| 343/344 | T397A | ++ | ++ |
| 345/346 | R395K | ++ | ++ |
| 347/348 | M324N/K394E/R395K/T397A | +++ | ++ |
| 349/350 | K389G | ++ | ++ |
| 351/352 | K389G/K394E/R395D | ++ | ++ |
| 353/354 | K389G/K394E/R395D/T397A | ++ | ++ |
| 355/356 | M324S/K394E/R395K | ++ | ++ |
| 357/358 | M324S/K389G/K394E/R395D | +++ | ++ |
| 359/360 | K394E/R395D | ++ | + |
| 361/362 | M324S/K394E | ++ | ++ |
| 363/364 | M324N/R395D | ++ | ++ |
| 365/366 | K389G/K394E | ++ | ++ |
| 367/368 | K389G/R395D | ++ | ++ |
| 369/370 | M324S/R395K | ++ | + |
| 371/372 | M324S/K394E/R395K/T397A | +++ | ++ |
| 373/374 | K389G/K394E/R395K/T397A | +++ | ++ |
| 375/376 | M324S/K389G/K394E | +++ | ++ |
| 377/378 | K389G/R395K | ++ | ++ |
| 379/380 | K389G/T397A | ++ | ++ |
| 381/382 | K389G/K394E/R395K | ++ | ++ |
| 383/384 | M324N | ++++ | ++ |
| 385/386 | K389G/K394E/T397A | ++ | ++ |
| 387/388 | M324S/K389G/K394E/T397A | ++ | ++ |
| 389/390 | K394E/R395K/T397A | ++ | ++ |

[1]All activities were determined relative to the reference polypeptide of SEQ ID NO: 234. Levels of increased activity are defined as follows: "+" = 0.9 to 1.1; "++" > 1.1; "+++" > 2; and "++++" > 3.

Example 5

LDC Variants of SEQ ID NO: 284

In this Example, experiments for evolution and screening of LDC variants derived from SEQ ID NO: 284, for improved leucine activity, low pH tolerance, and protease resistance are described. Directed evolution of the LDC encoded by SEQ ID NO: 284, was carried out by constructing libraries of variant genes. These libraries were then plated, grown, and screened using the methods described below.

HTP Activity Analysis of Clarified Lysates Pretreated with Acidic Buffer, Pepsin and Protease HTP growth and lysis of E. coli cells expressing LDC variants were performed as described in Example 2. Heat-treated lysates containing LDC variants were challenged with acidic buffer containing pepsin to simulate the gastric environment. First, heat-treated clarified lysate was preincubated 1:1 with McIlvaine buffer, pH 3.2, containing 0.05 g/L pepsin from porcine gastric mucosa (Sigma), in a COSTAR® 96-well round bottom plates (Corning). The plates were sealed and incubated for 1 h at 37° C. in a THERMOTRON® titre-plate shaker (250 rpm). Subsequently, the samples were centrifuged briefly, and the resulting supernatant was preincubated 1:1 with a final concentration of 0.5 g/L trypsin and chymotrypsin (1:1) for 1 h at 37° C. with shaking. After incubation, 40 µL of sample was added to 60 µL of reaction mix for a final concentration of 3 mM leucine and 10 µM PLP in 50 mM sodium phosphate, pH 7.0. Reactions were incubated for 1 h at 37° C. at 250 rpm in a THERMOTRON® titre-plate before being quenched with 3 volumes of acetonitrile with 0.1% formic acid, centrifuged for 10 min at 4° C. at 4000 rpm, and diluted 500-fold in water. The resulting samples were analyzed by RAPIDFIRE®-MS as described in Example 3.

TABLE 5-1

Relative Activity of LeuDC Variants Tested
(Relative to SEQ ID NO: 284)[1]

| SEQ ID NO: (nt/aa) | Amino Acid Differences (Relative to SEQ ID NO: 284) | Leu FIOP (Relative to SEQ ID NO: 284) |
|---|---|---|
| 391/392 | E64S/V69I/M324S/Q339A/A380E/K389G/P390* | +++ |
| 393/394 | V69I/S263T/K389G/P390* | +++ |
| 395/396 | E64S/V69I/Q339A/K389G/P390* | ++++ |
| 397/398 | N3M/E64S/V69I/S263T/Q339A/A380E/Q388A | +++ |
| 399/400 | N3M/V69I/M324S/A380E/A382S/K389G/P390* | +++ |
| 401/402 | V69I/Q339A/P390* | +++ |
| 403/404 | S263T/P390* | +++ |
| 405/406 | E64S/V69I/K389G | +++ |
| 407/408 | V69I/S263T | +++ |
| 409/410 | F48L/E64A/P255H | +++ |
| 411/412 | V69I/A223M/S263T/M324S/A382S/Q388A/P390* | +++ |
| 413/414 | V69I/M324S/K379D/A380E/Q388A | +++ |
| 415/416 | E64S/V69I/T189A/R259Q/S263T/A304R/Q339A/S340T/K379N | ++++ |
| 417/418 | V69I/S263T/Q339A | +++ |
| 419/420 | N3M/E64S/K379D/A380E/P390* | +++ |
| 421/422 | E64S/V69I/T189D/R259K/S263T/A304R | +++ |
| 423/424 | N3M/E64S/V69I/K389G | ++++ |
| 425/426 | E64S/V69I/A223M/Q388A | ++++ |
| 427/428 | S263T/Q339A/K389G/P390* | +++ |
| 429/430 | V69I/S263T/Q388A | +++ |
| 431/432 | G2E/E64S/V69I/M324S/A380E/A382S/Q388A/K389G | ++++ |
| 433/434 | E64S/M324S/Q339A/K389G/P390* | +++ |

TABLE 5-1-continued

Relative Activity of LeuDC Variants Tested
(Relative to SEQ ID NO: 284)[1]

| SEQ ID NO: (nt/aa) | Amino Acid Differences (Relative to SEQ ID NO: 284) | Leu FIOP (Relative to SEQ ID NO: 284) |
|---|---|---|
| 435/436 | V69I/A223M/M324S/K379D/A380E/A382S/Q388A/P390* | +++ |
| 437/438 | E64S/V69I/Q339A/A382S/Q388A/K389G | +++ |
| 439/440 | N3M/E64S/V69I/P390* | ++++ |
| 441/442 | E64S/V69I/P390* | ++++ |
| 443/444 | N3M/V69I/M324S | +++ |
| 447/448 | E64S/V69I/A223M/Q388A/K389G/P390* | ++++ |
| 449/450 | E64S/S263T | +++ |
| 451/452 | E64A/P255H/S263T | +++ |
| 453/454 | V69I/A382S/P390* | +++ |
| 455/456 | V69I/M324S/A380E | +++ |
| 457/458 | V69I/S263T/M324S | +++ |
| 459/460 | E64S/V69I | +++ |
| 461/462 | E64S/V69I/Q339A | ++++ |
| 463/464 | E64S/V69I/M324S | +++ |
| 465/466 | N3M/V69I/S263T/A380E | +++ |
| 467/468 | R259K/S263T/A304R/Q339A/S340T/K379N | +++ |
| 469/470 | R259K/S263T/A304R | +++ |
| 471/472 | S12G/R259K/S263T/A304R | +++ |
| 473/474 | E64S/V69I/K379D/A380E | +++ |
| 475/476 | S12G/L135V/R259K/S263T | +++ |
| 477/478 | E64S/V69I/A304R/K379E/A382G | +++ |
| 479/480 | A304R/S340T/K379D/A380E/A382G | +++ |
| 481/482 | S12G/L135V/S263T/A382G | +++ |
| 483/484 | E64S/V69I/A380E/Q388A/P390* | ++++ |

[1]All activities were determined relative to the reference polypeptide of SEQ ID NO: 284. Levels of increased activity are defined as follows: "+" = 0.9 to 1.1; "++" > 1.1; "+++" > 3; and "++++" > 5.

Example 6

LDC Variants of SEQ ID NO: 484

In this Example, experiments for evolution and screening of LDC variants derived from SEQ ID NO: 484, for improved leucine activity, low pH tolerance, and protease resistance are described. Directed evolution of the LDC encoded by SEQ ID NO: 484, was carried out by constructing libraries of variant genes. These libraries were then plated, grown, and screened using the methods described below.

HTP Activity Analysis of Clarified Lysates Pretreated with Acidic Buffer and Protease HTP growth and lysis of *E. coli* cells expressing LDC variants were performed as described in Example 2, with the exception that the lysis buffer contained 40 μM PLP. Heat-treated lysates containing LDC variants were challenged with acidic buffer containing pepsin and subsequently challenged with proteases as described in Example 5. Specifically, heat-treated clarified lysate was preincubated 1:1 with a final concentration of 0.375 g/L pepsin in McIlvaine buffer, pH 3, for 1 h at 37° C., and the resulting supernatant was preincubated 1:1 with a final concentration of 0.75 g/L trypsin and chymotrypsin (1:1) dissolved in 200 mM sodium phosphate, pH 8, for 1 h at 37° C. After incubation, 40 μL of sample was added to 60 μL of reaction mix for a final concentration of 3 mM leucine in 50 mM sodium phosphate, pH 7.0. Reactions were incubated, quenched, and analyzed as described in Example 5 with the exception that samples were diluted 50-fold in water before analysis by RAPID-FIRE®-MS. The results of these assays are shown in Table 6-1.

TABLE 6-1

Relative Activity of LeuDC Variants Tested
(Relative to SEQ ID NO: 484)[1]

| SEQ ID NO: (nt/aa) | Amino Acid Differences (Relative to SEQ ID NO: 484) | Leu FIOP (Relative to SEQ ID NO: 484) |
|---|---|---|
| 485/486 | R259K/A304R | ++ |
| 487/488 | R259K/S263T/A304R | ++ |
| 489/490 | R259K/S263T/A304R/M324S | ++ |
| 491/492 | N3M/R259K/A304R/M324S/Q339A | ++ |
| 493/494 | A304R/M324S | ++ |
| 495/496 | S263T/A304R/M324S | ++ |
| 497/498 | N3M/S263T/A304R/M324S/A382S | ++ |
| 499/500 | S263T/A304R/M324S/A382S | ++ |
| 501/502 | M324S | ++ |
| 503/504 | A382S | ++ |
| 505/506 | R259K/A304R/M324S/Q339A | ++ |
| 507/508 | S263T/M324S | ++ |
| 509/510 | R259K/A304R/M324S | +++ |
| 511/512 | N3M/R259K/A304R | ++ |
| 513/514 | R259K/S263T/A304R/A382S | ++ |
| 515/516 | N3M/S263T/A304R/M324S | ++ |
| 517/518 | R259K | ++ |
| 519/520 | N3M/A304R/M324S | ++ |
| 521/522 | N3M/R259K/S263T/A304R | ++ |
| 523/524 | S263T/A304R/M324S/Q339A | ++ |
| 525/526 | R259K/S263T/A304R/M324S/A382S | +++ |
| 527/528 | N3M/R259K/A304R/M324S/A382S | ++ |
| 529/530 | S263T/A304R | ++ |
| 531/532 | N3M/A304R | ++ |
| 533/534 | A304R | ++ |
| 535/536 | R259K/S263T/A304R/K379D | ++ |
| 537/538 | N3M/R259K/A304R/A382S | ++ |
| 539/540 | R259K/A304R/M324S/Q339A/A382S | ++ |
| 541/542 | R259K/S263T | +++ |
| 543/544 | R259K/A304R/A382S | ++ |
| 545/546 | N3M/S263T/A304R/M324S/Q339A | ++ |
| 547/548 | N3M/F194L/A304R | +++ |
| 549/550 | C328N | ++ |
| 551/552 | H87R/L270R/Q365E | + |
| 553/554 | L270R/C328N/P338S | ++ |

TABLE 6-1-continued

Relative Activity of LeuDC Variants Tested
(Relative to SEQ ID NO: 484)[1]

| SEQ ID NO: (nt/aa) | Amino Acid Differences (Relative to SEQ ID NO: 484) | Leu FIOP (Relative to SEQ ID NO: 484) |
|---|---|---|
| 555/556 | L270R/C328N/P338S/Q365E | ++ |
| 557/558 | L270R | ++ |
| 559/560 | L270R/I319A | ++ |
| 561/562 | H87R/C328N/Q365E | ++ |
| 563/564 | Q365E | ++ |
| 565/566 | C168K/L270R/C328N/P338S | ++ |
| 567/568 | H87R/L270R | ++ |
| 569/570 | R262G | ++ |
| 571/572 | T181R | ++ |
| 573/574 | H366T | ++ |
| 575/576 | H366Q | ++ |
| 577/578 | E92K | ++ |
| 579/580 | T181V | + |
| 581/582 | F194L | +++ |
| 583/584 | A63C | ++ |
| 585/586 | Y256W | + |
| 587/588 | G156A | + |
| 589/590 | H366M | ++ |
| 591/592 | R262D | ++ |
| 593/594 | R262T | ++++ |
| 595/596 | R262H | +++ |
| 597/598 | F194C | ++ |
| 599/600 | D126A | + |
| 601/602 | D352A | + |
| 603/604 | E201D | + |
| 605/606 | R16Q | ++ |
| 607/608 | H366L | ++ |
| 609/610 | R262S | +++ |
| 611/612 | A80K | ++ |
| 613/614 | H366V | ++ |
| 615/616 | D126T | ++ |
| 617/618 | T181K | ++ |
| 619/620 | A80G | + |
| 621/622 | E91A | ++ |
| 623/624 | M140V | + |
| 625/626 | H366A | + |
| 627/628 | G156S | + |
| 629/630 | E77L | + |
| 631/632 | E91Q | ++ |
| 633/634 | R262I | +++ |
| 635/636 | R16V | + |

[1] All activities were determined relative to the reference polypeptide of SEQ ID NO: 484. Levels of increased activity are defined as follows: "+" = 0.9 to 1.1; "++" > 1.1; "+++" > 2; and "++++" > 3.

Example 7

LDC Variants of SEQ ID NO: 594

In this Example, experiments for evolution and screening of LDC variants derived from SEQ ID NO: 594, for improved leucine activity, low pH tolerance, and protease resistance are described. Directed evolution of the LDC encoded by SEQ ID NO: 594, was carried out by constructing libraries of variant genes. These libraries were then plated, grown, and screened using the methods described below.

HTP Activity Analysis of Clarified Lysates Pretreated with Acidic Buffer and Protease HTP growth and lysis of *E. coli* cells expressing LDC variants were performed as described in Example 2, with the exception that the lysis buffer contained 40 μM PLP. Heat-treated lysates containing LDC variants were challenged with acidic buffer containing pepsin and subsequently challenged with proteases as described in Example 5. Specifically, heat-treated clarified lysate was preincubated 1:1 with a final concentration of 0.2 g/L pepsin in MeIlvaine buffer, pH 2.8, for 1 h at 37° C., and the resulting supernatant was preincubated 1:1 with a final concentration of 1.5 g/L trypsin and chymotrypsin (1:1) dissolved in 400 mM sodium phosphate, pH 8, for 1 h at 37° C. After incubation, 40 μL of sample was added to 60 μL of reaction mix for a final concentration of 2.5 mM leucine in 50 mM sodium phosphate, pH 7.0. Reactions were incubated, quenched, diluted, and analyzed as described in Example 6. The results of these assays are shown in Table 7-1.

TABLE 7-1

Relative Activity of LeuDC Variants Tested Under Various Conditions
(Relative to SEQ ID NO: 594)[1]

| SEQ ID NO: (nt/aa) | Amino Acid Differences (Relative to SEQ ID NO: 594) | Leu FIOP (Relative to SEQ ID NO: 594) |
|---|---|---|
| 637/638 | R16Q/M324S/C328N/H366M | ++ |
| 639/640 | R16Q/A63C/A80K/D126T/T181R/F194C/R259K/M324S/C328N/H366M | ++ |
| 641/642 | R16Q/C328N/H366M | ++ |
| 643/644 | A80K/D126T/T181R/L270R/M324S/H366M | ++ |
| 645/646 | R16Q/A80K/M324S | ++ |
| 647/648 | R16Q/A80K/D126T/M324S/H366M | ++ |
| 649/650 | R16Q/D126T/C168K/H366M | ++ |
| 651/652 | R16Q/C168K/H366M | ++ |
| 653/654 | A80K/D126T/C168K/L270R/H366M | +++ |
| 655/656 | R16Q/C168K/M324S/C328N/H366M | ++ |
| 657/658 | R16Q/C168K/M324S/H366M | ++ |
| 659/660 | R16Q/R259K/S263T/C328N | ++ |
| 661/662 | R16Q/A80K/D126T/H366M | ++ |
| 663/664 | C168K/H366M | ++ |
| 665/666 | R16Q/A80K/C168K | ++ |
| 667/668 | R16Q/A80K/C168K/L270R/H366M | +++ |
| 669/670 | R16Q/A63C/A80K/D126T/C168K/H366M | ++ |
| 671/672 | R16Q/E91A/D126T/C168K/M324S/H366M | ++ |
| 673/674 | R16Q/A63C/D126T/C168K/L270R/C328N/H366M | ++ |
| 675/676 | A80K/D126T/C168K/H366M | ++ |
| 677/678 | R16Q/A80K/C168K/H366M | ++ |
| 679/680 | R16Q/A80K/C168K/M324S | ++ |
| 681/682 | R16Q/C168K/L270R/M324S/H366M | ++ |
| 683/684 | A80K/C168K/L270R/H366M | ++ |
| 685/686 | R16Q/C168K/R259K/H366M | ++ |

[1] All activities were determined relative to the reference polypeptide of SEQ ID NO: 594. Levels of increased activity are defined as follows: "+" = 0.9 to 1.1; "++" > 1.1; "+++" > 2; and "++++" > 3.

Example 8

LDC Variants of SEQ ID NO: 686

In this Example, experiments for evolution and screening of LDC variants derived from SEQ ID NO: 686, for improved leucine activity, low pH tolerance, and protease resistance are described. Directed evolution of the LDC encoded by SEQ ID NO: 686, was carried out by constructing libraries of variant genes. These libraries were then plated, grown, and screened using the methods described below.

HTP Activity Analysis of Clarified Lysates Pretreated with Acidic Buffer and Protease HTP growth and lysis of *E. coli* cells expressing LDC variants were performed as described in Example 2, with the exception that the lysis buffer contained 40 μM PLP. Heat-treated lysates containing LDC variants were challenged with acidic buffer containing pepsin and subsequently challenged with proteases as described in Example 5. Specifically, heat-treated clarified lysate was preincubated 1:1 with a final concentration of 0.4 g/L pepsin in McIlvaine buffer, pH 2.8, for 1-1.5 h at 37° C., and the resulting supernatant was preincubated 1:1 with a final concentration of 2-4 g/L trypsin and 1.5 g/L chymotrypsin dissolved in 400 mM sodium phosphate, pH 8, for 1-2 h at 37° C. After incubation, 40 μL of sample was added to 60 μL of reaction mix for a final concentration of 2.5 mM leucine in 50 mM sodium phosphate, pH 7.0. In some experiments, reaction mix resulting in a final concentration of 2.5 mM leucine, isoleucine-$d_{10}$, valine, asparagine, methionine, and cysteine in 50 mM sodium phosphate, pH 7.0, was used. Reactions were incubated, quenched, diluted, and analyzed as described in Example 6. The results of these assays are provided in Tables 8-1 and 8-2.

TABLE 8-1

Relative Activity of LeuDC Variants Tested Under Various Conditions (Relative to SEQ ID NO: 686)[1]

| SEQ ID NO: (nt/aa) | Amino Acid Differences (Relative to SEQ ID NO: 686) | Leu FIOP (Relative to SEQ ID NO: 686) | 6 AA Mix FIOP (Relative to SEQ ID NO: 686) |
|---|---|---|---|
| 687/688 | S66N/T118D/D296E/R300K | ++ | ++ |
| 689/690 | S66N/T118D/H200S/D296E/A303Q/K317Q | ++ | ++ |
| 691/692 | R141P/M144V/A198G/H200S/R300K | ++ | ++ |
| 693/694 | S66N/T118D/D296E | ++ | ++ |
| 695/696 | A89P/T118D/H200S | ++ | ++ |
| 697/698 | T118D/R141P/H200S | ++ | ++ |
| 699/700 | R76V/R141P/A198G/H200S/E201R/R300K | ++ | ++ |
| 701/702 | S66N/R76V/T118D/R141P/E201R/R300K | ++ | ++ |
| 703/704 | R76V/T118D/R141P/H200S/D296E | ++ | ++ |
| 705/706 | S66N/H200S | ++ | ++ |
| 707/708 | S66N/R76V/A198G/H200S/D296E/A303Q | ++ | ++ |
| 709/710 | S66N/R76V/A198G/H200S/R300K | ++ | ++ |
| 711/712 | D126T | ++ | ++ |
| 713/714 | E201D/L270R/D352A | ++ | + |
| 715/716 | G156A/L270R/M324S | ++ | ++ |
| 717/718 | D126T/E201D/L270R/M324S | ++ | ++ |
| 719/720 | A80K/E201D/L270R | ++ | + |
| 721/722 | L270R | ++ | + |
| 723/724 | D126T/L270R | ++ | + |
| 725/726 | L106M/L270R/M324S/D352A | ++ | |
| 727/728 | L270R/M324S | + | + |
| 729/730 | G156A/L270R | ++ | + |
| 731/732 | E201D/L270R | ++ | + |
| 733/734 | A80K/L270R/M324S | ++ | + |
| 735/736 | A80K/L270R | ++ | ++ |

[1]All activities were determined relative to the reference polypeptide of SEQ ID NO: 686. Levels of increased activity are defined as follows: "+" = 0.9 to 1.1; "++" > 1.1; "+++" > 2; and "++++" > 3.

TABLE 8-2

Relative Activity of LeuDC Variants Tested Under Various Conditions (Relative to SEQ ID NO: 686)[1]

| SEQ ID NO: (nt/aa) | Amino Acid Differences (Relative to SEQ ID NO: 686) | Leu FIOP (Relative to SEQ ID NO: 686) | 6 AA Mix FIOP (Relative to SEQ ID NO: 686) |
|---|---|---|---|
| 737/738 | L19I | ++ | ++ |
| 739/740 | N134S | + | ++ |
| 741/742 | F173T | + | +++ |
| 743/744 | P170A | ++ | ++ |
| 745/746 | Y123M | + | ++ |
| 747/748 | V187L | ++ | ++ |
| 749/750 | A211S | ++ | ++ |
| 751/752 | F173I | ++ | ++++ |
| 753/754 | L109G | ++ | +++ |
| 755/756 | N134A | ++ | ++ |
| 757/758 | T312A | ++ | ++ |
| 759/760 | Y123V | ++ | ++ |
| 761/762 | F173A | ++ | +++ |
| 445/446 | Y123F | ++ | ++ |

[1]All activities were determined relative to the reference polypeptide of SEQ ID NO: 686. Levels of increased activity are defined as follows: "+" = 0.9 to 1.1; "++" > 1.1; "+++" > 2; and "++++" > 3.

Example 9

Amino Acid Activity Analysis of LDC Variants

In this Example, experiments for evaluating the activity of SEQ ID NO: 12 and 594 on all twenty amino acids are described.

Production of Shake Flask Powders (SFP)

Shake flask powders of LDC variants were prepared as described in Example 1, with the following changes: cell pellets were resuspended in 30 mL of 50 mM sodium phosphate, pH 7.0, with 200 μM PLP. After lysis using a single pass through a microfluidizer (Microfluidics) at 110 psi, the lysate was pelleted (10,000×rpm, 30 min, 4° C.), and the resulting supernatant was heat-treated at 60° C. for 1 h in a water bath. Samples were then centrifuged (10,000× rpm, 1 h, 4° C.) before the resulting supernatant was frozen and lyophilized to generate a powder containing the expressed enzyme.

SFP Characterization Assay for Decarboxylase Activity on Different Amino Acids

Shake flask powders were reconstituted in phosphate-buffered saline, pH 7.4, to provide stock solutions of 10 g/L powder. Then, 20 μL of these SFP solutions were added to 180 μL of reaction mix containing 2 mM of all twenty amino acids, with isoleucine-$d_{10}$ (Cambridge Isotope Laboratories) in place of isoleucine, dissolved in 50 mM sodium phosphate buffer, pH 7.0. Reactions were incubated for 1.5-2 h at 37° C. at 400 rpm in a THERMOTRON® titre-plate shaker before being quenched with 2 volumes of acetonitrile with 0.1% formic acid. The resulting samples were centrifuged for 10 min at 4° C. at 4000 rpm, and the supernatant was diluted up to 6-fold in acetonitrile with 0.1% formic acid. Samples were analyzed for all twenty amino acids by LC-MS/MS, and example LC-MS/MS instrument and parameters are shown in Tables 9-1 and 9-2. The conversion (i.e., depletion) of each amino acid was calculated relative to a negative control, and the results for SEQ ID NOS: 12 and 594 are shown in Table 9-2.

TABLE 9-1

HPLC-MS/MS Analysis of Amino Acids

| | |
|---|---|
| Instrument | Agilent ULTIVO ® Triple Quad MS |
| Column | Agilent INFINITYLAB ® POROSHELL ® 120 HILIC-OH5, 2.1 × 100 mm |
| Mobile phase | Gradient (A: 10% 0.2M Ammonium formate pH 3, 90% water; B: 10% 0.2M Ammonium formate pH 3, 90% acetonitrile) |

| Time (m) | % B |
|---|---|
| 0 | 100 |
| 10 | 70 |
| 11 | 100 |
| 15 | 100 |

| | |
|---|---|
| Flow rate | 0.8 mL/m |
| Run time | 16 m |
| Column temperature | 30° C. |
| Injection volume | 0.25 μL |
| MS conditions | MODE: MRM, ESI Positive; Gas temp & flow: 250° C., 7 mL/min; Nebulizer: 45 psi; Sheath gas temp & flow: 11 mL/min; Capillary voltage: 3500 V; Nozzle voltage: 0 V |

TABLE 9-2

HPLC-MS/MS Analysis of Amino Acids (cont.)

| Compound name | Precursor (m/z) | Product (m/z) | Dwell (ms) | Fragmentor (V) | CE (V) | Polarity |
|---|---|---|---|---|---|---|
| Alanine | 90.1 | 44.1 | 10 | 25 | 8 | Positive |
| Arginine | 175.1 | 70.1 | 75 | 25 | 28 | Positive |
| Asparagine | 133.1 | 87.1 | 10 | 25 | 20 | Positive |
| Aspartate | 134 | 74 | 10 | 25 | 15 | Positive |
| Cysteine | 122.1 | 59 | 15 | 25 | 20 | Positive |
| Glutamate | 148.1 | 84.1 | 10 | 75 | 16 | Positive |
| Glutamine | 147.1 | 84 | 10 | 25 | 20 | Positive |
| Glycine | 76 | 30.1 | 15 | 25 | 5 | Positive |
| Histidine | 156.1 | 110 | 25 | 25 | 12 | Positive |
| Isoleucine | 132.1 | 86.1 | 10 | 25 | 8 | Positive |
| Isoleucine-d10 | 142.1 | 96.1 | 10 | 25 | 8 | Positive |
| Leucine | 132.1 | 86.1 | 10 | 25 | 8 | Positive |
| Lysine | 147.1 | 84.1 | 50 | 25 | 16 | Positive |
| Methionine | 150 | 104 | 10 | 75 | 8 | Positive |
| Phenylalanine | 166.1 | 120.1 | 10 | 25 | 5 | Positive |
| Proline | 116.1 | 70.1 | 10 | 50 | 16 | Positive |
| Serine | 106.1 | 60.1 | 10 | 25 | 8 | Positive |
| Threonine | 120 | 74.1 | 10 | 25 | 10 | Positive |
| Tryptophan | 205.2 | 146 | 10 | 50 | 20 | Positive |
| Tyrosine | 182.1 | 136.1 | 10 | 25 | 12 | Positive |
| Valine | 118.1 | 72.1 | 10 | 25 | 8 | Positive |

TABLE 9-3

Percent Conversion of LeuDC Variants on Different Amino Acids[1]

| Amino Acid | SEQ ID NO: 12 | SEQ ID NO: 594 |
|---|---|---|
| Ala | + | |
| Arg | + | |
| Asn | ++++ | ++++ |
| Asp | | |
| Cys | ++ | ++ |
| Gln | + | |
| Glu | + | |
| Gly | + | + |
| His | + | |
| Ile-$d_{10}$ | +++ | +++ |
| Leu | ++++ | ++++ |
| Lys | + | |
| Met | ++ | +++ |
| Phe | +++ | + |
| Pro | + | + |
| Ser | + | |
| Thr | + | + |
| Trp | ++ | + |
| Tyr | + | |
| Val | +++ | +++ |

[1] Activity levels are represented as % conversion and are defined as follows: "+" > 0.1%; "++" > 20%; "+++" > 40%; and "++++" > 60%.

Example 10

LDC Variants of SEQ ID NO: 688

In this Example, experiments for evolution and screening of LDC variants derived from SEQ ID NO: 688, for improved leucine activity, low pH tolerance, and protease resistance are described. Directed evolution of the LDC encoded by SEQ ID NO: 688, was carried out by constructing libraries of variant genes. These libraries were then plated, grown, and screened using the methods described below.

HTP Activity Analysis of Clarified Lysates Pretreated with Acidic Buffer and Protease HTP growth and lysis of E. coli cells expressing LDC variants were performed as described in Example 2, with the exception that the lysis buffer contained 20 mM sodium phosphate and 40 μM PLP. Heat-treated lysates containing LDC variants were challenged with acidic buffer containing pepsin and subsequently challenged with proteases as described in Example 5. Specifically, heat-treated clarified lysate was preincubated 1:1 with a final concentration of 0.4 g/L pepsin in McIlvaine buffer, pH 3, for 1.5 h at 37° C., and the resulting supernatant was preincubated 1:1 with a final concentration of 4 g/L trypsin and 1.5 g/L chymotrypsin dissolved in 400 mM sodium phosphate, pH 8, for 2 h at 37° C. After incubation, 40 μL of sample was added to 60 UL of reaction mix, resulting in a final concentration of 2.5 mM leucine, isoleucine-$d_{10}$, valine, asparagine, methionine, and cysteine in simulated intestinal fluid. Reactions were incubated, quenched, diluted, and analyzed as described in Example 6. The results of these assays are provided in Tables 10-1.

HTP Activity Analysis of Clarified Lysates Pretreated with Acidic Buffer and Protease HTP growth and lysis of E. coli cells expressing LDC variants were performed as described in Example 10. Heat-treated lysates containing LDC variants were challenged with acidic buffer containing pepsin and subsequently challenged with proteases as described in Example 5. Specifically, heat-treated clarified lysate was preincubated 1:1 with a final concentration of 0.8 g/L pepsin in McIlvaine buffer, pH 2.6-2.8, for 2 h at 37° C., and the resulting supernatant was preincubated 1:1 with a final concentration of 4 g/L trypsin and 1.5 g/L chymotrypsin dissolved in 400 mM sodium phosphate, pH 8, for 2 h at 37° C. After incubation, 40 μL of sample was added to 60 μL of reaction mix, resulting in a final concentration of 2-3 mM leucine, isoleucine-$d_{10}$, valine, asparagine, methionine, and cysteine in simulated intestinal fluid. Reactions were incubated, quenched, diluted, and analyzed as described in Example 6. The results of these assays are provided in Tables 11-1 and 11-2.

HTP Activity Analysis of Clarified Lysates on Leucine

HTP growth and lysis of E. coli cells expressing LDC variants were performed as described in Example 10. Heat-treated lysates were diluted 20-fold in water, and 20 μL of sample was added to 80 μL of reaction mix, resulting in a final concentration of 3 mM leucine in 50 mM sodium phosphate, pH 7. Reactions were incubated, quenched, diluted, and analyzed as described in Example 6. Activities on leucine were normalized by the concentration of leucine decarboxylase in heat-treated clarified lysates, which was determined by SDS-PAGE and size exclusion chromatography. The results of these assays are provided in Tables 11-2.

TABLE 10-1

Relative Activity of LeuDC Variants On Leucine After Simulated Gastrointestinal Challenge Conditions (Relative to SEQ ID NO: 688)[1]

| SEQ ID NO: (nt/aa) | Amino Acid Differences (Relative to SEQ ID NO: 688) | AA Mix FIOP (Relative to SEQ ID NO: 688) |
|---|---|---|
| 763/764 | L19I/L109G/A211S/L270R/T312A | ++++ |
| 765/766 | L19I/L109G/Y123F/P170A/A211S/L270R/T312A | ++++ |
| 767/768 | L19I/L109G/Y123V/R141P/P170A/A198G/A211S/L270R/T312A | +++ |
| 769/770 | L19I/L109G/P170A/F173I/A211S/L270R/T312A | ++++ |
| 771/772 | L109G/A211S/L270R/T312A | ++++ |
| 773/774 | L19I/L109G/Y123F/A198G/H200S/A211S/L270R/T312A | ++++ |
| 775/776 | L109G/P170A/A211S/L270R/T312A | ++++ |
| 777/778 | L19I/L109G/Y123V/R141P/P170A/A198G/H200S/A211S/L270R/T312A | +++ |
| 779/780 | L19I/L109G/Y123V/R141P/P170A/A198G/A211S | +++ |

[1]All activities were determined relative to the reference polypeptide of SEQ ID NO: 688. Levels of increased activity are defined as follows: "+" = 0.9 to 1.1; "++" > 4; "+++" > 7; and "++++" > 10.

Example 11

LDC Variants of SEQ ID NO: 766

In this Example, experiments for evolution and screening of LDC variants derived from SEQ ID NO: 766, for improved leucine activity, low pH tolerance, and protease resistance are described. Directed evolution of the LDC encoded by SEQ ID NO: 766, was carried out by constructing libraries of variant genes. These libraries were then plated, grown, and screened using the methods described below.

TABLE 11-1

Relative Activity of LeuDC Variants Tested On Leucine After Simulated Gastrointestinal Challenge Conditions (Relative to SEQ ID NO: 766)[1]

| SEQ ID NO: (nt/aa) | Amino Acid Differences (Relative to SEQ ID NO: 766) | AA Mix FIOP (Relative to SEQ ID NO: 766) |
|---|---|---|
| 781/782 | K5V/H41D | +++ |
| 783/784 | K5V/H41D/T228D | +++ |
| 785/786 | H41D | ++ |
| 787/788 | T331V | ++ |
| 789/790 | D353I | + |
| 791/792 | V55I | +++ |

TABLE 11-1-continued

Relative Activity of LeuDC Variants Tested On Leucine After Simulated Gastrointestinal Challenge Conditions (Relative to SEQ ID NO: 766)[1]

| SEQ ID NO: (nt/aa) | Amino Acid Differences (Relative to SEQ ID NO: 766) | AA Mix FIOP (Relative to SEQ ID NO: 766) |
|---|---|---|
| 793/794 | S64N | ++ |
| 795/796 | L47F | ++ |
| 797/798 | L51E | +++ |
| 799/800 | D353L | ++ |
| 801/802 | L51Q | ++ |
| 803/804 | P384W | + |
| 805/806 | C357S | ++ |
| 807/808 | I267L | ++ |
| 809/810 | D126A | ++ |
| 811/812 | F33L | ++ |
| 813/814 | D126T | ++ |
| 815/816 | R270T | ++ |
| 817/818 | R270A | + |
| 819/820 | E265P | ++ |
| 821/822 | D353E | + |

[1] All activities were determined relative to the reference polypeptide of SEQ ID NO: 766. Levels of increased activity are defined as follows: "+" 1.0 to 1.1, "++" > 1.1, "+++" > 1.5

TABLE 11-2

Relative Activity of LeuDC Variants Tested Under Various Conditions (Relative to SEQ ID NO: 766)[1]

| SEQ ID NO: (nt/aa) | Amino Acid Differences (Relative to SEQ ID NO: 766) | AA Mix FIOP (Relative to SEQ ID NO: 766) | Leu Normalized FIOP (Relative to SEQ ID NO: 766) |
|---|---|---|---|
| 823/824 | D118T/K300R | | + |
| 825/826 | D118T | | + |
| 827/828 | N66S | | +++ |
| 829/830 | E296D | ++ | |
| 831/832 | N66S/D118T | | +++ |
| 833/834 | K300R | ++ | + |
| 835/836 | N66S/D118T/E296D | | +++ |
| 837/838 | E296D/K300R | ++ | + |
| 839/840 | N66S/E296D/K300R | | +++ |
| 841/842 | N66S/E296D | | +++ |
| 843/844 | N66S/K300R | | +++ |
| 845/846 | D118T/E296D | + | ++ |
| 847/848 | N66S/D118T/E296D/K300R | | +++ |
| 849/850 | N66S/D118T/K300R | | +++ |
| 851/852 | D118T/E296D/K300R | + | + |

[1] All activities were determined relative to the reference polypeptide of SEQ ID NO: 766. Levels of increased activity are defined as follows: "+" = 0.9 to 1.1; "++" > 1.1; and "+++" > 1.5.

Example 12

In Vivo Characterization of LDC Variants in Healthy Cynomolgus Monkeys

In vivo pharmacodynamic studies were conducted in healthy cynomolgus monkeys (n=12, male, 3-4 kg BW) to characterize three LDC variants (SEQ ID: 484; SEQ ID: 686; and SEQ ID: 766). Each variant was dosed at either 25, 50, or 100 mg/kg. The study was carried out over four weeks consisting of four dosing days, each separated by a one-week washout period. Dosing groups were rotated, so that animals did not receive the same dose twice. One day prior to dosing, animals were separated into individual cages and fasted overnight. On each dosing day 10 g of whey protein powder (BN Labs Grass Fed Whey Protein; 9.14% leucine), formulated with water for a total volume of 20 mL/animal, was provided by oral gavage. Immediately after whey protein suspension, either vehicle (20 mM sodium phosphate, 0.4 mM pyridoxal phosphate, pH 7.2) or the appropriate dose of LDC was given at 2.5 mL/kg, followed by a 4 mL rinse of water to ensure efficient delivery of all material using the same gavage tube. Animals were provided their normal meal at 8 hours, immediately after blood collection, on dosing days. Blood samples were obtained at 90 minutes and 30 minutes pre-prandial, and at 5, 15, 30 minutes, as well as 1, 2, 4, 8, 12, and 24 hours post-prandial (the 24 hour time point was collected the following day, prior to feeding). Samples were transferred into tubes containing the anticoagulant, $K_2$EDTA, placed on wet ice pending processing, and centrifuged at 2500 rpm for 10 minutes at approximately 4° C. The resulting plasma was recovered and stored frozen (≤−60° C.) until analysis. Plasma leucine, phenylalanine, tyrosine, and methionine were quantified using LC-MS/MS to evaluate efficacy. A significant increase in plasma leucine was observed with meal challenge alone, compared to pre-prandial baseline. All LDC variants at all doses resulted in a significant suppression in plasma leucine in response to a whey protein meal challenge. SEQ ID: 484 and SEQ ID: 686 demonstrated efficacy in a dose responsive manner. All doses of SEQ ID:766 showed similar efficacy, which was superior to both SEQ ID: 484 and SEQ ID: 686. LDC had no effect on plasma phenylalanine, tyrosine, or methionine. Table 12-1 summarizes the percent reduction in incremental area under the curve (iAUC) plasma leucine with treatment compared to vehicle. iAUC was reported by first subtracting pre-prandial leucine values (fasted background) from each post-prandial time point value for each animal, and then performing AUC calculations. Statistical calculations and significance were determined using GraphPad Prism 7 (GraphPad Software).

TABLE 12-1

% Reduction in Plasma Leucine in Healthy Cynomolgus Monkeys with LeuDC Variants in Response to a Whey Protein Meal (% Reduction in iAUC Relative to Vehicle)

| SEQ ID NO: | 25 mg/kg | 50 mg/kg | 100 mg/kg |
|---|---|---|---|
| SEQ ID NO: 484 | 32.3 | 28.9 | 45.7 |
| SEQ ID NO: 686 | 33.4 | 49.6 | 58.1 |
| SEQ ID NO: 766 | 48 | 53.8 | 52.6 |

Example 13

In Vivo Characterization of LDC Variants in Mouse Models of Disease

In vivo pharmacodynamic studies were conducted in a mouse model of Intermediate Maple Syrup Urine Disease (iMSUD; (Dbt$^{tm1Geh}$ Tg(Cebpb-tTA)5Bjd Tg(tetO-DBT)A1Geh/J; JAX stock #6999)) to characterize three LDC variants (SEQ ID: 484; SEQ ID: 686; and SEQ ID: 766). Each variant was dosed at 200 mg/kg. Prior to dosing and starting at weaning, iMSUD mice were maintained on leucine free mouse chow with leucine supplemented in the drinking water (5.75 g leucine/L), in order to support growth and extend survival. Animals at least 2 months old and 20 g BW were used for experiments. Animals were fasted overnight (~15 hours) prior to dosing. On each dosing day 45 mg whey protein powder (BN Labs Grass Fed Whey Protein; 9.14% leucine), formulated with water for a total volume of 100 mL/animal, was provided by oral gavage. Immediately following whey protein suspension, either vehicle (20 mM sodium phosphate, 0.4 mM pyridoxal phosphate, pH 7.2) or the appropriate LDC variant was given at 5 mL/kg. Blood samples were obtained at 15 minutes pre-prandial, and at 15, 30, 60, 120, and 240 minutes post-prandial. Samples were transferred into tubes containing the anticoagulant, $K_2EDTA$, placed on wet ice pending processing, and centrifuged at 2500 rpm for 10 minutes at approximately 4° C. The resulting plasma was recovered and stored frozen (≤−60° C.) until analysis. Plasma leucine was quantified using LC-MS/MS to evaluate efficacy. A significant increase in plasma leucine was observed with meal challenge alone compared to pre-prandial baseline. All LDC variants resulted in a significant suppression in plasma leucine in response to a whey protein meal challenge. SEQ ID: 484 and SEQ ID: 686 demonstrated similar efficacy, while SEQ ID: 766 resulted in superior efficacy. Table 13-1 summarizes the percent reduction in iAUC plasma leucine with treatment compared to vehicle. iAUC was reported by first subtracting pre-prandial leucine values (fasted background) from each post-prandial time point value for each animal, and then performing AUC calculations. Statistical calculations and significance were determined using GraphPad Prism 7 (GraphPad Software).

TABLE 13-1

% Reduction in Plasma Leucine in the iMSUD Mouse Model with LeuDC Variants in Response to a Whey Protein Meal (% Reduction in iAUC Relative to Vehicle)

| SEQ ID NO: | 200 mg/kg |
| --- | --- |
| SEQ ID NO: 484 | 30.6 |
| SEQ ID NO: 686 | 30 |
| SEQ ID NO: 766 | 45 |

While the invention has been described with reference to the specific embodiments, various changes can be made and equivalents can be substituted to adapt to a particular situation, material, composition of matter, process, process step or steps, thereby achieving benefits of the invention without departing from the scope of what is claimed.

For all purposes in the United States of America, each and every publication and patent document cited in this disclosure is incorporated herein by reference as if each such publication or document was specifically and individually indicated to be incorporated herein by reference. Citation of publications and patent documents is not intended as an indication that any such document is pertinent prior art, nor does it constitute an admission as to its contents or date.

SEQUENCE LISTING (852 sequences)

SEQ ID NO: 1 - DNA, 1701 bp, Artificial Sequence
  Wild Type Amino Acid Decarboxylase from Streptomyces sp. GP55
atgagcatttcatcttctccgctggatatcttagcggcggcctccgcagtggacagcggcccagccgttgatccgggtcctgaactggattgccgcgactttgagcttccggcttcggggttggatgatgcacgtcgtctgcatgtcctggataccgtggacgaatatctgacgcgtaaacgtcgccacctggttggttaccaggctacccaagacatgcagggctgtgcgctcgatttagcacgtttcatgcccaacaacatcaataatcttggcgatccgtttcagagtggaggatataaaccaaacactaaggtagtagaacgcgccgtgctggactactacgcgaaattatggcgcgctaatggtccgcatgatcctgcggatccggagagctattggggctatatgttgtcgatgggtagtacagaaggcaacatgtatgccctctggaatgcacgcgactacctctccgggaaagcgctgattcaaccacccaccgccccgttcgaagcgctgcgctatgtcaaagcacgtccggatcgcagcaaccctaatgctcaccgtccggtggccttctactcagaagacacgcattattcgtttgcgaaggcagttcgcgtcctgggtgtggagacctttcacgctgttggctgggaattgtacccggatgaatgcccactggtggatccggccactggccgtcgtgagtggcccattgaagtaccgagttctcctggtccgtcaggtacgtcctgggatgggccaggcgaaatcgacgtcgatagcctggcggtgctggtcgagttctttgcagcgaaaggtcatccgatttttgtgaaccttaacttgggaagcaccttcaaaggcgcccatgacgatgttcgcggcgtttgtgaacgcctgctgccgatctttgaagaacacgggctcattcagcgtgaggtggtgtatggtacagatcgtcgtaccggcgaacctttagtagacttacgccgcggtttctggatccatgttgatggcgcccttggtgcgggatatgcgccatttatgcgcatggctagtcaggacccggcagcacacggttggacgcccgatgtcgagttgccggaatacgattttggcttaacccttccgactcgtgaattcggtgacctcgatatggtgtcgtcgattgccatgagcggccataaatggcctggcgccccatggccttgcgggatttatatgacgaaggttaaataccaaatctctccgccgtcccagccggactataccggtgctccagatacaacatttgccgggagccgtaacggtttctctccgttggtcatttgggatcacctttcacgccatagttaccaggatcaagtagatcgtatccgtgacgcacaggccttggctgactatctcgaatgtcgcttacgtgcaatggaaggagagttaggcgtggaattgtggccagctcgtactccgggtgccgttaccgtgcgctttcgcaaacctagcgcagaactcgtagccaaatggtcacttagctcccaagacgtcttaatggttccgggcgatgagatgacccgtcgttcgtacgtgcatgtcttcttgatgcccagtgttgatcgcgcaaaattggatgccctccttgctgaattagctgaagatccggcaattcgcggtttacccgcccgttctgcataatag

SEQ ID NO: 2 - protein, 565 aa, Artificial Sequence
  Wild Type Amino Acid Decarboxylase from Streptomyces sp. GP55
MSISSSPLDILAAASAVDSGPAVDPGPELDCRDFELPASGLDDARRLHVLDTVDEYLTRKRRHLVGYQATQDMQGCALDLARFMPNNINNLGDPFQSGGYKPNTKVVERAVLDYYAKLWRANGPHDPADPESYWGYMLSMGSTEGNMYALWNARDYLSGKALIQPPTAPFEALRYVKARPDRSNPNAHRPVAFYSEDTHYSFAKAVRVLGVETFHAVGWELYPDECPLVDPATGRREWPIEVPSSPGPSGTSWDGPGEIDVDSLAVLVEFFAAKGHPIFVNLNLGSTFKGAHDDVRGVCERLLPIFEEHGLIQREVVYGTDRRTGEPLVDLRRGFWIHVDGALGAGYAPFMRMASQDPAAHGWTPDVELPEYDFGLTLPTREFGDLDMVSSIAMSGHKWPGAPWPCGIYMTKVKYQISPPSQPDYTGAPDTTFAGSRNGFSPLVIWDHLSRHSYQDQVDRIRDAQALADYLECRLRAMEGELGVELWPARTPGAVTVRFRKPSAELVAKWSLSSQDVLMVPGDEMTRRSYVHVFLMPSVDRAKLDALLAELAEDPAIRGLPARSA

SEQ ID NO: 3 - DNA, 1722 bp, Artificial Sequence
  Wild Type Amino Acid Decarboxylase from Saccharothrix sp. ST-888
atgagtcgtaccgatactctgacggtgcatattggtcacgacgaattagctcgcccggatgttctgatcccaccattggatggccctgggctgtgcgtaccgcagggacctgcggagcccgacgtctgtgactttgaactccctgcaggtggcctggatgatgaacagcgtttacgcgcactggataccatggacgagtatctgacaggtaaacgccgctaccttctcggctatcaggcaacccaggaaatgggtggaagcgcgttcgatttaggccgttttatgcagcataacattaataatttgggtgatcccttccaatctggcgggtacaaaccaaacactaaggtggtggaacgtgccgttctggactattatgcggcgttatggcacgctaaaggcccctacaacgccgatgatccacagtcgtattggggctacgtcctttcaatgggtagcacggagggcaatatgtatgcattgtggaacgcgcgtgactacctctccggtaaagccttaatccagccacctaccggtcccagtggcgcgttgcgctatgttcaagcaccttctgaaccatccaaccccaatgcttaccgtcctgtggccttctatagcgaagacacgcattacagctttgcgaaagcagtacacgtgcttggagtcgagacctttcatgctgttggcacagaacagtatccagatgagtgccctttagcaggtccaaccgcggaacctcgcgaatggccagcggaagtaccctcacgctcgggtccttcgggccatagttgggatggcacgggagagattgatatcgatgctctcgcagtgttggtcgaattctttgcggcgaaaggtcaccccatttttgtgagcctcaacttaggctccactttcaagggcgctcatgacgacgttcgtcaagtgtgtgaacgccttctccccatctttgagaaacacggtttggttcagggtgaagtcgtctatggcaaagatccagtgaccggcgaacctcttgttgatttgcgtcgtcgcttctggattcatgtagatggagcattaggtgcgggatacgcgccatttatgcgcatggctgacgcagatccagcgggctttggttggacacctgacacccgtgtgcccgaattcgattttggcatcaccttaccaactcgcgagttcggtgacctcgatatggtgagcagcattgcgatgtctggccacaaatggcctggtgcaccatggccctgcggcatctatatgacgaaggtcaaataccagatttcgcctccttcccaacccgattatattggtgctccagacaccacgtttgcaggctcacgtaatggattctcaccccttgttttgtgggatcatcttagtcgccattcttaccgtgatcaggtagatcgcatccgtcgtgcgcaagaattagcggcgtacctcgaacagcagttgcgctttttagaacgcgagaaagacattgaattatggccagctcgtacgcccggcgcaatcaccgtgcgctttcgtaaacctagtccagaactcgttgctaagtggagcttgtcgtcgcaagatgtgcttttggttcctggtgacgagaccacacgtcgcagctatgtccacgtgttcctcatgtcctccgtagatcgtgcgaaacttgacgcgctcttggaagatcttggcaatgatcccgcagttttacgccgcccataatag

SEQ ID NO: 4 - protein, 572 aa, Artificial Sequence
  Wild Type Amino Acid Decarboxylase from Saccharothrix sp. ST-888
MSRTDTLTVHIGHDELARPDVLIPPLDGPGLCVPQGPAEPDVCDFELPAGGLDDEQRLRALDTMDEYLTGKRRYLLGYQATQEMGGSAFDLGRFMQHNINNLGDPFQSGGYKPNTKVVERAVLDYYAALWHAKGPYNADDPQSYWGYVLSMGSTEGNMYALWNARDYLSGKALIQPPTGPSGALRYVQAPSEPSNPNAYRPVAFYSEDTHYSFAKAVHVLGVETFHAVGTEQYPDECPLAGPTAEPREWPAEVPSRSGPSGHSWDGTGEIDIDALAVLVEFFAAKGHPIFVSLNLGSTFKGAHDDVRQVCERLLPIFEKHGLVQGEVVYGKDPVTGEPLVDLRRRFWIHVDGALGAGYAPFMRMADADPAGFGWTPDTRVPEFDFGITLPTREFGDLDMVSSIAMSGHKWPGAPWPCGIYMTKVKYQISPPSQPDYIGAPDTTFAGSRNGFSPLVLWDHLSRHSYRDQVDRIRRAQELAAYLEQQLRFLEREKDIELWPARTPGAITVRFRKPSPELVAKWSLSSQDVLLVPGDETTRRSYVHVFLMSSVDRAKLDALLEDLGNDPAVLRRP

SEQ ID NO: 5 - DNA, 1779 bp, Artificial Sequence
  Wild Type Amino Acid Decarboxylase from Kitasatospora sp. MBT63
atgcgtcgtaccgatacgttaacattggacctgggtcatggccacggtgcgccggcacgcagcgatgcccgcatgtcaccacttggcgtgccggctcaggcaagtgcgccttctccggccccgggcggaccactcgcgcctgctgaagaaccggcgctgtgcgactttctgctgccggcagatgggctggatgatgagcaacgtttacgcgcattggacactatggatgcctatctgaccggtaaacgccgctacctgctgggctatcaggcaacccaggaaatgggtggttcggccttcgaccttggccgttttatgcatcataacattaataatctcggagatcccttccaaagcggcggctacaaaccgaacacgaaggttgttgagcgtgccgtcctggactattatgcggcgttatggcacgcggatggtccatacgatgccgccgatccgcagtcctattggggctacgtgttgtcgatgggtagcaccgaagggaacatgtatgcactgtggaatgctcgcgactaccttagtggcaaagcattaatccagcctcctactggtccatgtggagcggcgcgttacgtaaaagctccggcagaaccgggtaacccgaatgcctatcgcccagtggcgttctattccgaagatacgcactacagctttgcgaaagcggtccatgtactcggcgtggagacctttcatgccgttggcaccgaacaatatccggatgaatgccccttgccggctgctgcaggaggtgcagcagccggcgccgcctctggtcctcgtgagtggcccgctgaagtgccctcacacagtggcccaagcggtcattcttgggatggaacgggcgagattgacgtcgaagcccttgctgttctcgtggaattctttgcagccaagggccacccgatctttgtctcgttaaacttgggctccacattcaaaggtgctcatgacgacgtacgcggtgtgtgtgaacgtcttctcccgatttttgagaaatacggtttaatccagggcgaagttgcctatggaaaagatccgcgcaccggcgaaccgttggttgatttacgtcgtcgcttctggattcacgtggatggcgcactcggtgcaggctatgccccgtttttgcgcatggctgctgacgatccagcaggttttggatgggagccggatactcgtcttcccgaattcgactttggcatcaccttacctacgcgcgaattcggtgacctcgatatggtgtcaagcattgccatgagcggtcataagtggcctggtgcaccatggccatgcggcatctacatgaccaaagtcaaatatcagattgcacctccgtctcaacccgattacattggcgcccccgatacgacttttgcaggatcgcgtaacggcttctcccctcttatcttgtgggaccatttaagtcgccacagctatcaggatcaagtagatcgtattcgtcgtgcccaggacttggctgcttacctcgaacaacaacttcgtttgttggagctcgagaaagatgtcgaattatggccagcacgcacaccaggtgccatcaccgttcgctttcgcaaacctagtcccgaacttgtagccaagtggagcctttcatcacaggatgtgttaaccgttccaggcgacgaatctacgcgccgctcctatgtgcatgtgttcctcatgtcgtcggttgatcgtgccaaattagacgcattgttggctgatctcggtaatgatcccgtgattttacgccgcccataatag

SEQ ID NO: 6 - protein, 591 aa, Artificial Sequence
  Wild Type Amino Acid Decarboxylase from Kitasatospora sp. MBT63
MRRTDTLTLDLGHGHGAPARSDARMSPLGVPAQASAPSPAPGGPLAPAEEPALCDFLLPADGLDDEQRLRALDTMDAYLTGKRRYLLGYQATQEMGGSAFDLGRFMHHNINNLGDPFQSGGYKPNTKVVERAVLDYYAALWHADGPYDAADPQSYWGYVLSMGSTEGNMYALWNARDYLSGKALIQPPTGPCGAARYVKAPAEPGNPNAYRPVAFYSEDTHYSFAKAVHVLGVETFHAVGTEQYPDECPLPAAAGGAAAGAASGPREWPAEVPSHSGPSGHSWDGTGEIDVEALAVLVEFFAAKGHPIFVSLNLGSTFKGAHDDVRGVCERLLPIFEKYGLIQGEVAYGKDPRTGEPLVDLRRRFWIHVDGALGAGYAPFLRMAADDPAGFGWEPDTRLPEFDFGITLPTREFGDLDMVSSIAMSGHKWPGAPWPCGIYMTKVKYQIAPPSQPDYIGAPDTTFAGSRNGFSPLILWDHLSRHSYQDQVDRIRRAQDLAAYLEQQLRLLELEKDVELWPARTPGAITVRFRKPSPELVAKWSLSSQDVLTVPGDESTRRSYVHVFLMSSVDRAKLDALLADLGNDPVILRRP

SEQ ID NO: 7 - DNA, 1665 bp, Artificial Sequence
  Wild Type Amino Acid Decarboxylase from Kitasatospora sp. MMS16-BH015
atgagtccgtttgaaaccatgaatcctgcggcggatcaggagctgccaccattagccttggctggccatcgtcttccgcaaccgccggcagaagaacctcaggtggccgagtatgcaattccagttggtggtttagaccgcgaacaacgtctgcgcgctctcgatcgcatcgatacgtaccttgcacacaaacgtcagcatttgttgggctatcaggctaaccaggaactcgatggatgcgcgtctgacttaggtcgtttcatgcgccacaacattaataatttaggcgatccctttcgtagcggcgggtacaaacccaacactaaggccgtcgaacatgcagtactcgactattatgccgatctttggcgcgcgaaaggtcctcactcgccagaggatcccgaatcctactgggggtatgcgctttcaatgggaagcaccgaaggcaacatgtacgcgttgtggaatgcccgcgactatctcagcggtaagcctttaatccgtcctacagcatctagtggctcaggagcagtggtgacgccaaactcgcgtcgcccagttgccttctacagcgaggacacccattattcctttgcgaaagctgtacgtgttttgggtgtcgaaaccttccacgatattggcgtggaaaactatccaggtcagtgtccactccctggcagtggtggtgtgtggccccttgaagttcccagtgttcctggtccctcgggattatcttgggatggcacgggcgaaatcagcgtggatgcgctcgaattgttggtcgagttctttgcggctaaaggccatcccgtctttgtgtcccttaatttaggcagcacctttaaaggtgcccatgacgacgtacgcgcagtttgcgaacgtttgctccccattttcgaacgctacggcatggtggagtcagaggtcgtacgcggtcgtgatcaacgtagcggcgagcttcttactgatcgccgccgtcgcttctggatccacgtggacggagccttaggtgcggcctacctcccttttttacgtttggcgcaggaatccccagaaacatatggttggacaccagctgcaccagcgcctgagtttgattttggcttgcgcttaccaaccgctggccatggcgaagttgatctcgtcagctcgattgccatgtctggacacaaatggcctggtgttccttggccctgtggcatctacatgacgaaagtgaagtatcaagtgagtcctccctctcagccagactataccggtgcacctgatactactttcgcgggctcacgtaacggcttttcgccacttgtactctgggatcatttagcccgccatagccacgccgaccaagtcgatcgtattcgccgctcccaggaattggcggcataccttgaaagccgtttaaccgcattggaacgtacccatggtcttaccttatggcctgctcgcacaccaggagctttaaccgttcgtttccgtaaacctagtcccgaactcgtgactaaatggtcgttgtcagcccaggatgttctcacgactccaggtgaagaagcaacccgccgctcctatgtgcacgtcttcttaatgccaagcgtaacccgtgagaaattggatgcgctccttgatgacctcgtgaatgaccccgtgattacaggctcctaatag

SEQ ID NO: 8 - protein, 553 aa, Artificial Sequence
  Wild Type Amino Acid Decarboxylase from Kitasatospora sp. MMS16-BH015
MSPFETMNPAADQELPPLALAGHRLPQPPAEEPQVAEYAIPVGGLDREQRLRALDRIDTYLAHKRQHLLGYQANQELDGCASDLGRFMRHNINNLGDPFRSGGYKPNTKAVEHAVLDYYADLWRAKGPHSPEDPESYWGYALSMGSTEGNMYALWNARDYLSGKPLIRPTASSGSGAVVTPNSRRPVAFYSEDTHYSFAKAVRVLGVETFHDIGVENYPGQCPLPGSGGVWPLEVPSVPGPSGLSWDGTGEISVDALELLVEFFAAKGHPVFVSLNLGSTFKGAHDDVRAVCERLLPIFERYGMVESEVVRGRDQRSGELLTDRRRRFWIHVDGALGAAYLPFLRLAQESPETYGWTPAAPAPEFDFGLRLPTAGHGEVDLVSSIAMSGHKWPGVPWPCGIYMTKVKYQVSPPSQPDYTGAPDTTFAGSRNGFSPLVLWDHLARHSHADQVDRIRRSQELAAYLESRLTALERTHGLTLWPARTPGALTVRFRKPSPELVTKWSLSAQDVLTTPGEEATRRSYVHVFLMPSVTREKLDALLDDLVNDPVITGS

SEQ ID NO: 9 - DNA, 1620 bp, Artificial Sequence
  Wild Type Amino Acid Decarboxylase from Streptomyces sp. NRRL F-6131
atgagtccaaccaccgcgcgtgctgcagttgcacgcgcggcgctggatggcgccttagaccgtgctgtcgtggatcgcgccgtagtagatcgtgccgtggttgaaggtgcagctgttcctggaccggtccatgttgacgcagagccggaaggcgccgattttgcaattccggccgaaggtctgacggatggcgaacgtttacgcgcccttgaccgcatggatgggtatctgactcgtaaacgtcgtcacctcgtgggttaccaggctacacaagagctggctggtagcgccctggatttagcacgcttcatgctgtccaacatcaataatttgggcgacccctttcagtctggcgggtataaaccgaacacgaaggtcgtcgaacgcgccgtactggattactacgcccgcctttggcatgcaggtccatcgtatgaccctgcagatccggagtcatattggggctatatgctgagcatgggaagtaccgaaggcaacatgtacgccctctggaatgctcgcgactatttaactcgtccaggtgcaccgcgtccggttgccttctacagcgaagatacccactatagctttgctaaagccgttcgcgtactgggtgtcgatacgttccatgcagtaggaaccgccgattaccccgatgaatgccctcttggtggcgagtggccggctgaagttccgtctcagccaggcccttcaggtttgtcgtgggacggcagtggcgcagtcgacttagatgcactggccgccctggtcgagttctttgctgctaaaggtcacccggtctttgttaactttaatttgggctccaccttcaaaggagcccatgatgatgtacgtggtgcatgtgaacgcctcctcccgatttttgaacgccatggcttattaccacgtgcaggttcagatgctcgtcgtggcttctggatccacgttgatggtgcattgggtgccggttatgccccctttcttcgcatggcttctgcagatcctgccgcatttggctgggaaccggaggccgaactcccggaattcgactttggccttacgttggctacacgcgaaagcggcgacgtagatccagttgcatcgattgccatgagcggacataaatgggctggtgtaccctggccatgcggcgtcttcatgaccaagactaaatatcaacttgaacctcctacgcagcccgagtacattggtgccccagactccacctttgccggaagtcgtaacggctttagcccattggttttatgggatcacttatctcgcctctcgcatcgtgatcaagtcgatcgtatccgccgctcccaggaactcgctgcatatcttgagcgtcgtttgcgcgaagttgaacgcgaaacaggcgcagaattgtggccagcacgcacgcctggtgctatcaccgtacgtttccgtaaaccttcagccggattggttgccaagtggagccttagttcggagaacgttttaacaactcccggtgatcctgccggcttacgtggctacgtacacgtctttctcatgccatcagtcgaccgtgctaaattagacgctcttctcgacgatttggctcgtgatcccgtcattcttggtcgcgcttaatag

SEQ ID NO: 10 - protein, 538 aa, Artificial Sequence
  Wild Type Amino Acid Decarboxylase from Streptomyces sp. NRRL F-6131
MSPTTARAAVARAALDGALDRAVVDRAVVDRAVVEGAAVPGPVHVDAEPEGADFAIPAEGLTDGERLRALDRMDGYLTRKRRHLVGYQATQELAGSALDLARFMLSNINNLGDPFQSGGYKPNTKVVERAVLDYYARLWHAGPSYDPADPESYWGYMLSMGSTEGNMYALWNARDYLTRPGAPRPVAFYSEDTHYSFAKAVRVLGVDTFHAVGTADYPDECPLGGEWPAEVPSQPGPSGLSWDGSGAVDLDALAALVEFFAAKGHPVFVNFNLGSTFKGAHDDVRGACERLLPIFERHGLLPRAGSDARRGFWIHVDGALGAGYAPFLRMASADPAAFGWEPEAELPEFDFGLTLATRESGDVDPVASIAMSGHKWAGVPWPCGVFMTKTKYQLEPPTQPEYIGAPDSTFAGSRNGFSPLVLWDHLSRLSHRDQVDRIRRSQELAAYLERRLREVERETGAELWPARTPGAITVRFRKPSAGLVAKWSLSSENVLTTPGDPAGLRGYVHVFLMPSVDRAKLDALLDDLARDPVILGRA

SEQ ID NO: 11 - DNA, 1224 bp, Artificial Sequence
  Wild Type Leucine Decarboxylase from Planctomycetaceae bacterium
atgggtaatctgaaatttccagatggcgcgttgagcccgcatgaccgccgccgtctggaagatgtgtatcagtacgttcgtgagcaatgcgacaccttcattgggtatccgtgtacgatgcactttgattacacacctcttttaccgttcctggcctatcccgtcaacaacgtaggcgatccgtttgctgcatccagttatcgcgtgcatacccgtgaaatcgaacgcgaggttctggcgtggttcgccgaactcatgcacattgcaccagaagaatactggggttatgtgactaatggaggaaccgagggcaacctgtacggtttgtttttagcgcgtgaacgctttcctacgggcgtcgcctactattcggaagacacccattatagcgtgtataagaatctgcgtctgctgaacatgcgtcacatcatgatcaaatcacagccgaatggtgagattgattacggcgatctctacgaaactatgcgcattcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgattccttgcggcatcgttttgacacgcaaacattatgtggagcgtattgctcgcagtatcgaatatgtcggtaccctggacactacgattaccggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgcgtcgtaatccatgcgccattaccgttgtgttcccgaaacctccgcagtcagtgctgcacaagtggcaaatcgcagttaacggcgaccgcgcgcatattattttaatgccaagtaccaccctccagcatgtcgatgaattgatcgctgacattgcagccgccaataaagcggctgcagcaccgagcgatacgcagaaacccgccgccaagaaacgcccgacaccggctggtgcaccgcaacgtactacgtaatag

SEQ ID NO: 12 - protein, 406 aa, Artificial Sequence
  Wild Type Leucine Decarboxylase from Planctomycetaceae bacterium
MGNLKFPDGALSPHDRRRLEDVYQYVREQCDTFIGYPCTMHFDYTPLLPFLAYPVNNVGDPFAASSYRVHTREIEREVLAWFAELMHIAPEEYWGYVTNGGTEGNLYGLFLARERFPTGVAYYSEDTHYSVYKNLRLLNMRHIMIKSQPNGEIDYGDLYETMRIHRDCPPIIFANIGTTMTEGIDNVRTIQDMFKKLAIHESHIHCDAALAGMTLPFMDDAPAFDFATGIDSLSISGHKFIGSPIPCGIVLTRKHYVERIARSIEYVGTLDTTITGSRNGITPLFLWYAVKQAGRDGFKRRVAACLDNARYTVEQFKRIGVEARRNPCAITVVFPKPPQSVLHKWQIAVNGDRAHIILMPSTTLQHVDELIADIAAANKAAAAPSDTQKPAAKKRPTPAGAPQRTT

SEQ ID NO: 13 - DNA, 1185 bp, Artificial Sequence
  Wild Type Amino Acid Decarboxylase from Larkinella arboricola
atgaccgtgaaagaagttgaacgtctgcagcgctataaagatctgttagcggaacgtagcagcaacgccattggttacccgtttgcactcgacttcgatttttcggagttgcatacgctgttccaatatcacatcaataatgtgggcgacccatacatcgagtccaactacgatgtcaactctcatagtatggaacgcgaggtcgtagaattctttgctgatctgtttcgtgcgccgaagcacaatcgctgggggtatgttacttcaggaggatcggaaggtaacctttatggtctgtatgtggcccgcgaactgtatcctgaagcggtgatttactactccgcagctacccattacagcattagcaaatctatccgtttgttgaatatgccgtcgtgcatgattcgtattcagcccaacggtgagatggactataaagatctggaagaaagtatcaaacgctattcaaatcgtccggccatcgttgttgcgaacatcgggacgacaatgaccgaagcaaaggatgatgtaccaaccattcgctccgtgcttcagaaagcggcggtgaaaagccactacatccattgtgacgctgccttaagtgggtcttatctggcagtcctcgaggaggaaccgcaatttgacttcgccaacggtgtcgatagcattgcatgctcaggacacaagttcattggttcgccttttccgtgtggtgtagtggtgatcaaagatcagtacaaagaacgcgtttctaaacccgtcagctatattgggtcctttgacagtactattgctggaagccgtaatggtcattcgccggttttcatgtggtatgccatcaaacagcaggggcgcgaaggtctgctgcgtcgtgcgttagagtgcctgtctctggcggaatacacacaacgccgcctccaggaacatggtattgcggcgtggcgtaacgaaaaggcaatcacggtggtgtttccaaaaccgtccgcctcaatctgtcgcaaatggcaacttgccaccaatgcaggacaggctcacctgatttgcatgccagggattagccaacagcgcatcgatgattttattgaggacctgctgaaagaaaccagtttgattgcgcgtgaaccgacgcatagccgtgtcttcgttaaacctggtgattcgatcatgattacccagctgtaatag

SEQ ID NO: 14 - protein, 393 aa, Artificial Sequence
  Wild Type Amino Acid Decarboxylase from Larkinella arboricola
MTVKEVERLQRYKDLLAERSSNAIGYPFALDFDFSELHTLFQYHINNVGDPYIESNYDVNSHSMEREVVEFFADLFRAPKHNRWGYVTSGGSEGNLYGLYVARELYPEAVIYYSAATHYSISKSIRLLNMPSCMIRIQPNGEMDYKDLEESIKRYSNRPAIVVANIGTTMTEAKDDVPTIRSVLQKAAVKSHYIHCDAALSGSYLAVLEEEPQFDFANGVDSIACSGHKFIGSPFPCGVVVIKDQYKERVSKPVSYIGSFDSTIAGSRNGHSPVFMWYAIKQQGREGLLRRALECLSLAEYTQRRLQEHGIAAWRNEKAITVVFPKPSASICRKWQLATNAGQAHLICMPGISQQRIDDFIEDLLKETSLIAREPTHSRVFVKPGDSIMITQL

SEQ ID NO: 15 - DNA, 1221 bp, Artificial Sequence
  Variant of Leucine Decarboxylase from Planctomycetaceae bacterium
atgggtaatctgaaatttccagatggcgcgttgagcccgcatgaccgccgccgtctggaagatgtgtatcagtacgttcgtgagcaatgcgacaccttcctggggtatccggtaaacatgcactttgattacacacctcttttaccgttcctggcctatcccgtcaacaacgtgggcgatccgtttgctgcatccagttatcgcgtgcatacccgtgaaatcgaacgcgaggttctggcgtggttcgccgaactcatgcacattgcaccagaagaatactggggttatgtgactaatggaggaaccgagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcattcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaacattatgtggagcgtattgctcgcagtattgaatatgtcggtaccctggacactacgattacgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgcgtcgtaatccatgcgccattaccgttgtgttcccgaaacctccgcagtcagtgctgcacaagtggcaaatcgcagtagagggcgaccgcgcgcatattgtcttaatgccaagtaccaccctccagcatgtcgatgaattgatcgctgacattgcagccgccaataaagcggctgcagcaccgagcgatacgcagaaacccgccgccaagaaacgcccgacaccggctggtgcaccgcaacgtactacgtag

SEQ ID NO: 16 - protein, 406 aa, Artificial Sequence
  Variant of Leucine Decarboxylase from Planctomycetaceae bacterium
MGNLKFPDGALSPHDRRRLEDVYQYVREQCDTFLGYPVNMHFDYTPLLPFLAYPVNNVGDPFAASSYRVHTREIEREVLAWFAELMHIAPEEYWGYVTNGGTEGNLYGLFLARERFPTGVAYYSEDSHYSVYKNLRLLNMRHIMIKSQPNGEIDYGDLYETMRIHRDCPPIIFANIGTTMTEGIDNVRTIQDMFKKLAIHESHIHCDAALAGMTLPFMDDAPAFDFATGIDSLSISGHKFIGSPMPCGIVLTRKHYVERIARSIEYVGTLDTTITGSRNGITPLFLWYAVKQAGRDGFKRRVAACLDNARYTVEQFKRIGVEARRNPCAITVVFPKPPQSVLHKWQIAVEGDRAHIVLMPSTTLQHVDELIADIAAANKAAAAPSDTQKPAAKKRPTPAGAPQRTT

SEQ ID NO: 17 - DNA, 1221 bp, Artificial Sequence
  Variant of Leucine Decarboxylase from Planctomycetaceae bacterium
atgggtaatctgaaatttccagatggcgcgttgagcccgcatgaccgccgccgtctggaagatgtgtatcagtacgttcgtgagcaatgcgacaccttcatcgggtatccgtgcaacatgcactttgattacacacctcttttaccgttcctggcctatcccgtcaacaacgtgggcgatccgtttgctgcatccagttatcgcgtgcatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagacacccattatagcgtgtataagaatctgcgtctgctgaacatgcgtcacatcatgatcaaatcacagccgaatggtgagattgattacggcgatctctacgaaactatgcgcattcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgattccttgcggcatcgttttgacacgcaaacattatgtggagcgtattgctcgcagtgttgaatatgtcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgcgtcgtaatccatgcgccattaccgttgtgttcccgaaacctccgcagtcagtgctgcacaagtggcaaatcgcagttaacggcgaccgcgcgcatattgtcttaatgccaagtaccaccctccagcatgtcgatgaattgatcgctgacattgcagccgccaataaagcggctgcagcaccgagcgatacgcagaaacccgccgccaagaaacgcccgacaccggctggtgcaccgcaacgtactacgtag

SEQ ID NO: 18 - protein, 406 aa, Artificial Sequence
  Variant of Leucine Decarboxylase from Planctomycetaceae bacterium
MGNLKFPDGALSPHDRRRLEDVYQYVREQCDTFIGYPCNMHFDYTPLLPFLAYPVNNVGDPFAASSYRVHTREIEREVLAWFAELMHIAPEEYWGYVTNGGSEGNLYGLFLARERFPTGVAYYSEDTHYSVYKNLRLLNMRHIMIKSQPNGEIDYGDLYETMRIHRDCPPIIFANIGTTMTEGIDNVRTIQDMFKKLAIHESHIHCDAALAGMTLPFMDDAPAFDFATGIDSLSISGHKFIGSPIPCGIVLTRKHYVERIARSVEYVGTLDTTISGSRNGITPLFLWYAVKQAGRDGFKRRVAACLDNARYTVEQFKRIGVEARRNPCAITVVFPKPPQSVLHKWQIAVNGDRAHIVLMPSTTLQHVDELIADIAAANKAAAAPSDTQKPAAKKRPTPAGAPQRTT

SEQ ID NO: 19 - DNA, 1221 bp, Artificial Sequence
  Variant of Leucine Decarboxylase from Planctomycetaceae bacterium
atgggtaatctgaaatttccagatggcgcgttgagcccgcatgaccgccgccgtctggaagatgtgtatcagtacgttcgtgagcaatgcgacaccttcctggggtatccggtaaacatgcactttgattacacacctcttttaccgttcctggcctatcccgtcaacaacgtgggcgatccgtttgctgcatccagttatcgcgtgcatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagacacccattatagcgtgtataagaatctgcgtctgctgaacatgcgtcacatcatgatcaaatcacagccgaatggtgagattgattacggcgatctctacgaaactatgcgcattcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgattccttgcggcatcgttttgacacgcaaacattatgtggagcgtattgctcgcagtatcgaatatgtcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgcgtcgtaatccatgcgccattaccgttgtgttcccgaaacctccgcagtcagtgctgcacaagtggcaaatcgcagttaacggcgaccgcgcgcatattgtcttaatgccaagtaccaccctccagcatgtcgatgaattgatcgctgacattgcagccgccaataaagcggctgcagcaccgagcgatacgcagaaacccgccgccaagaaacgcccgacaccggctggtgcaccgcaacgtactacgtag

SEQ ID NO: 20 - protein, 406 aa, Artificial Sequence
  Variant of Leucine Decarboxylase from Planctomycetaceae bacterium
MGNLKFPDGALSPHDRRRLEDVYQYVREQCDTFLGYPVNMHFDYTPLLPFLAYPVNNVGDPFAASSYRVHTREIEREVLAWFAELMHIAPEEYWGYVTNGGSEGNLYGLFLARERFPTGVAYYSEDTHYSVYKNLRLLNMRHIMIKSQPNGEIDYGDLYETMRIHRDCPPIIFANIGTTMTEGIDNVRTIQDMFKKLAIHESHIHCDAALAGMTLPFMDDAPAFDFATGIDSLSISGHKFIGSPIPCGIVLTRKHYVERIARSIEYVGTLDTTISGSRNGITPLFLWYAVKQAGRDGFKRRVAACLDNARYTVEQFKRIGVEARRNPCAITVVFPKPPQSVLHKWQIAVNGDRAHIVLMPSTTLQHVDELIADIAAANKAAAAPSDTQKPAAKKRPTPAGAPQRTT

SEQ ID NO: 21 - DNA, 1221 bp, Artificial Sequence
  Variant of Leucine Decarboxylase from Planctomycetaceae bacterium
atgggtaatctgaaatttccagatggcgcgttgagcccgcatgaccgccgccgtctggaagatgtgtatcagtacgttcgtgagcaatgcgacaccttcatcgggtatccgtgcaacatgcactttgattacacacctcttttaccgttcctggcctatcccgtcaacaacgtgggcgatccgtttgctgcatccagttatcgcgtgcatacccgtgaaatcgaacgcgaggttctggcgtggttcgccgaactcatgcacattgcaccagaagaatactggggttatgtgactaatggaggaaccgagggcaacctgtacggtttgtttttagcgcgtgaacgctttcctacgggcgtcgcctactattcggaagacacgcattatagcgtgtataagaatctgcgtctgctgaacatgcgtcacatcatgatcaaatcacagccgaatggtgagattgattacggcgatctctacgaaactatgcgcattcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaacattatgtggagcgtattgctcgcagtgttgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgcgtcgtaatccatgcgccattaccgttgtgttcccgaaacctccgcagtcagtgctgcacaagtggcaaatcgcagtaaatggcgaccgcgcgcatattgtcttaatgccaagtaccaccctccagcatgtcgatgaattgatcgctgacattgcagccgccaataaagcggctgcagcaccgagcgatacgcagaaacccgccgccaagaaacgcccgacaccggctggtgcaccgcaacgtactacgtag

SEQ ID NO: 22 - protein, 406 aa, Artificial Sequence
  Variant of Leucine Decarboxylase from Planctomycetaceae bacterium
MGNLKFPDGALSPHDRRRLEDVYQYVREQCDTFIGYPCNMHFDYTPLLPFLAYPVNNVGDPFAASSYRVHTREIEREVLAWFAELMHIAPEEYWGYVTNGGTEGNLYGLFLARERFPTGVAYYSEDTHYSVYKNLRLLNMRHIMIKSQPNGEIDYGDLYETMRIHRDCPPIIFANIGTTMTEGIDNVRTIQDMFKKLAIHESHIHCDAALAGMTLPFMDDAPAFDFATGIDSLSISGHKFIGSPMPCGIVLTRKHYVERIARSVEYIGTLDTTISGSRNGITPLFLWYAVKQAGRDGFKRRVAACLDNARYTVEQFKRIGVEARRNPCAITVVFPKPPQSVLHKWQIAVNGDRAHIVLMPSTTLQHVDELIADIAAANKAAAAPSDTQKPAAKKRPTPAGAPQRTT

SEQ ID NO: 23 - DNA, 1221 bp, Artificial Sequence
  Variant of Leucine Decarboxylase from Planctomycetaceae bacterium
atgggtaatctgaaatttccagatggcgcgttgagcccgcatgaccgccgccgtctggaagatgtgtatcagtacgttcgtgagcaatgcgacaccttcatcgggtatccggtaaacatgcactttgattacacacctcttttaccgttcctggcctatcccgtcaacaacgtgggcgatccgtttgctgcatccagttatcgcgtgcatacccgtgaaatcgaacgcgaggttctggcgtggttcgccgaactcatgcacattgcaccagaagaatactggggttatgtgactaatggaggaacggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcattcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgattccttgcggcatcgttttgacacgcaaacattatgtggagcgtattgctcgcagtgttgaatatgtcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgcgtcgtaatccatgcgccattaccgttgtgttcccgaaacctccgcagtcagtgctgcacaagtggcaaatcgcagtaaatggcgaccgcgcgcatattatcttaatgccaagtaccaccctccagcatgtcgatgaattgatcgctgacattgcagccgccaataaagcggctgcagcaccgagcgatacgcagaaacccgccgccaagaaacgcccgacaccggctggtgcaccgcaacgtactacgtag

SEQ ID NO: 24 - protein, 406 aa, Artificial Sequence
  Variant of Leucine Decarboxylase from Planctomycetaceae bacterium
MGNLKFPDGALSPHDRRRLEDVYQYVREQCDTFIGYPVNMHFDYTPLLPFLAYPVNNVGDPFAASSYRVHTREIEREVLAWFAELMHIAPEEYWGYVTNGGTEGNLYGLFLARERFPTGVAYYSEDSHYSVYKNLRLLNMRHIMIKSQPNGEIDYGDLYETMRIHRDCPPIIFANIGTTMTEGIDNVRTIQDMFKKLAIHESHIHCDAALAGMTLPFMDDAPAFDFATGIDSLSISGHKFIGSPIPCGIVLTRKHYVERIARSVEYVGTLDTTISGSRNGITPLFLWYAVKQAGRDGFKRRVAACLDNARYTVEQFKRIGVEARRNPCAITVVFPKPPQSVLHKWQIAVNGDRAHIILMPSTTLQHVDELIADIAAANKAAAAPSDTQKPAAKKRPTPAGAPQRTT

SEQ ID NO: 25 - DNA, 1221 bp, Artificial Sequence
  Variant of Leucine Decarboxylase from Planctomycetaceae bacterium
atgggtaatctgaaatttccagatggcgcgttgagcccgcatgaccgccgccgtctggaagatgtgtatcagtacgttcgtgagcaatgcgacaccttcatcgggtatccgtgcaacatgcactttgattacacacctcttttaccgttcctggcctatcccgtcaacaacgtgggcgatccgtttgctgcatccagttatcgcgtgcatacccgtgaaatcgaacgcgaggttctggcgtggttcgccgaactcatgcacattgcaccagaagaatactggggttatgtgactaatggaggaaccgagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcattcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaacattatgtggagcgtattgctcgcagtatcgaatatgtcggtaccctggacactacgattaccggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgcgtcgtaatccatgcgccattaccgttgtgttcccgaaacctccgcagtcagtgctgcacaagtggcaaatcgcagtaaatggcgaccgcgcgcatattgtcttaatgccaagtaccaccctccagcatgtcgatgaattgatcgctgacattgcagccgccaataaagcggctgcagcaccgagcgatacgcagaaacccgccgccaagaaacgcccgacaccggctggtgcaccgcaacgtactacgtag

SEQ ID NO: 26 - protein, 406 aa, Artificial Sequence
  Variant of Leucine Decarboxylase from Planctomycetaceae bacterium
MGNLKFPDGALSPHDRRRLEDVYQYVREQCDTFIGYPCNMHFDYTPLLPFLAYPVNNVGDPFAASSYRVHTREIEREVLAWFAELMHIAPEEYWGYVTNGGTEGNLYGLFLARERFPTGVAYYSEDSHYSVYKNLRLLNMRHIMIKSQPNGEIDYGDLYETMRIHRDCPPIIFANIGTTMTEGIDNVRTIQDMFKKLAIHESHIHCDAALAGMTLPFMDDAPAFDFATGIDSLSISGHKFIGSPMPCGIVLTRKHYVERIARSIEYVGTLDTTITGSRNGITPLFLWYAVKQAGRDGFKRRVAACLDNARYTVEQFKRIGVEARRNPCAITVVFPKPPQSVLHKWQIAVNGDRAHIVLMPSTTLQHVDELIADIAAANKAAAAPSDTQKPAAKKRPTPAGAPQRTT

SEQ ID NO: 27 - DNA, 1221 bp, Artificial Sequence
  Variant of Leucine Decarboxylase from Planctomycetaceae bacterium
atgggtaatctgaaatttccagatggcgcgttgagcccgcatgaccgccgccgtctggaagatgtgtatcagtacgttcgtgagcaatgcgacaccttcctggggtatccgtgcaacatgcactttgattacacacctcttttaccgttcctggcctatcccgtcaacaacgtaggcgatccgtttgctgcatccagttatcgcgtgcatacccgtgaaatcgaacgcgaggttctggcgtggttcgccgaactcatgcacattgcaccagaagaatactggggttatgtgactaatggaggaaccgagggcaacctgtacggtttgtttttagcgcgtgaacgctttcctacgggcgtcgcctactattcggaagacacccattatagcgtgtataagaatctgcgtctgctgaacatgcgtcacatcatgatcaaatcacagccgaatggtgagattgattacggcgatctctacgaaactatgcgcattcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgattccttgcggcatcgttttgacacgcaaacattatgtggagcgtattgctcgcagtatcgaatatgtcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgcgtcgtaatccatgcgccattaccgttgtgttcccgaaacctccgcagtcagtgctgcacaagtggcaaatcgcaaccgagggcgaccgcgcgcatattgtcttaatgccaagtaccaccctccagcatgtcgatgaattgatcgctgacattgcagccgccaataaagcggctgcagcaccgagcgatacgcagaaacccgccgccaagaaacgcccgacaccggctggtgcaccgcaacgtactacgtag

SEQ ID NO: 28 - protein, 406 aa, Artificial Sequence
  Variant of Leucine Decarboxylase from Planctomycetaceae bacterium
MGNLKFPDGALSPHDRRRLEDVYQYVREQCDTFLGYPCNMHFDYTPLLPFLAYPVNNVGDPFAASSYRVHTREIEREVLAWFAELMHIAPEEYWGYVTNGGTEGNLYGLFLARERFPTGVAYYSEDTHYSVYKNLRLLNMRHIMIKSQPNGEIDYGDLYETMRIHRDCPPIIFANIGTTMTEGIDNVRTIQDMFKKLAIHESHIHCDAALAGMTLPFMDDAPAFDFATGIDSLSISGHKFIGSPIPCGIVLTRKHYVERIARSIEYVGTLDTTISGSRNGITPLFLWYAVKQAGRDGFKRRVAACLDNARYTVEQFKRIGVEARRNPCAITVVFPKPPQSVLHKWQIATEGDRAHIVLMPSTTLQHVDELIADIAAANKAAAAPSDTQKPAAKKRPTPAGAPQRTT

SEQ ID NO: 29 - DNA, 1221 bp, Artificial Sequence
  Variant of Leucine Decarboxylase from Planctomycetaceae bacterium
atgggtaatctgaaatttccagatggcgcgttgagcccgcatgaccgccgccgtctggaagatgtgtatcagtacgttcgtgagcaatgcgacaccttcatcgggtatccgtgcaacatgcactttgattacacacctcttttaccgttcctggcctatcccgtcaacaacgtgggcgatccgtttgctgcatccagttatcgcgtgcatacccgtgaaatcgaacgcgaggttctggcgtggttcgccgaactcatgcacattgcaccagaagaatactggggttatgtgactaatggaggaacggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcattcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaacattatgtggagcgtattgctcgcagtgttgaatatgtcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgcgtcgtaatccatgcgccattaccgttgtgttcccgaaacctccgcagtcagtgctgcacaagtggcaaatcgcagtagagggcgaccgcgcgcatattgtcttaatgccaagtaccaccctccagcatgtcgatgaattgatcgctgacattgcagccgccaataaagcggctgcagcaccgagcgatacgcagaaacccgccgccaagaaacgcccgacaccggctggtgcaccgcaacgtactacgtag

SEQ ID NO: 30 - protein, 406 aa, Artificial Sequence
  Variant of Leucine Decarboxylase from Planctomycetaceae bacterium
MGNLKFPDGALSPHDRRRLEDVYQYVREQCDTFIGYPCNMHFDYTPLLPFLAYPVNNVGDPFAASSYRVHTREIEREVLAWFAELMHIAPEEYWGYVTNGGTEGNLYGLFLARERFPTGVAYYSEDSHYSVYKNLRLLNMRHIMIKSQPNGEIDYGDLYETMRIHRDCPPIIFANIGTTMTEGIDNVRTIQDMFKKLAIHESHIHCDAALAGMTLPFMDDAPAFDFATGIDSLSISGHKFIGSPMPCGIVLTRKHYVERIARSVEYVGTLDTTISGSRNGITPLFLWYAVKQAGRDGFKRRVAACLDNARYTVEQFKRIGVEARRNPCAITVVFPKPPQSVLHKWQIAVEGDRAHIVLMPSTTLQHVDELIADIAAANKAAAAPSDTQKPAAKKRPTPAGAPQRTT

SEQ ID NO: 31 - DNA, 1221 bp, Artificial Sequence
  Variant of Leucine Decarboxylase from Planctomycetaceae bacterium
atgggtaatctgaaatttccagatggcgcgttgagcccgcatgaccgccgccgtctggaagatgtgtatcagtacgttcgtgagcaatgcgacaccttcatcgggtatccggtaaacatgcactttgattacacacctcttttaccgttcctggcctatcccgtcaacaacgtgggcgatccgtttgctgcatccagttatcgcgtgcatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcattcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgattccttgcggcatcgttttgacacgcaaacattatgtggagcgtattgctcgcagtgttgaatatatcggtaccctggacactacgattacgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgcgtcgtaatccatgcgccattaccgttgtgttcccgaaacctccgcagtcagtgctgcacaagtggcaaatcgcagtagagggcgaccgcgcgcatattgtcttaatgccaagtaccaccctccagcatgtcgatgaattgatcgctgacattgcagccgccaataaagcggctgcagcaccgagcgatacgcagaaacccgccgccaagaaacgcccgacaccggctggtgcaccgcaacgtactacgtag

SEQ ID NO: 32 - protein, 406 aa, Artificial Sequence
  Variant of Leucine Decarboxylase from Planctomycetaceae bacterium
MGNLKFPDGALSPHDRRRLEDVYQYVREQCDTFIGYPVNMHFDYTPLLPFLAYPVNNVGDPFAASSYRVHTREIEREVLAWFAELMHIAPEEYWGYVTNGGSEGNLYGLFLARERFPTGVAYYSEDSHYSVYKNLRLLNMRHIMIKSQPNGEIDYGDLYETMRIHRDCPPIIFANIGTTMTEGIDNVRTIQDMFKKLAIHESHIHCDAALAGMTLPFMDDAPAFDFATGIDSLSISGHKFIGSPIPCGIVLTRKHYVERIARSVEYIGTLDTTITGSRNGITPLFLWYAVKQAGRDGFKRRVAACLDNARYTVEQFKRIGVEARRNPCAITVVFPKPPQSVLHKWQIAVEGDRAHIVLMPSTTLQHVDELIADIAAANKAAAAPSDTQKPAAKKRPTPAGAPQRTT

SEQ ID NO: 33 - DNA, 1221 bp, Artificial Sequence
  Variant of Leucine Decarboxylase from Planctomycetaceae bacterium
atgggtaatctgaaatttccagatggcgcgttgagcccgcatgaccgccgccgtctggaagatgtgtatcagtacgttcgtgagcaatgcgacaccttcatcgggtatccgtgcaacatgcactttgattacacacctcttttaccgttcctggcctatcccgtcaacaacgtgggcgatccgtttgctgcatccagttatcgcgtgcatacccgtgaaatcgaacgcgaggttctggcgtggttcgccgaactcatgcacattgcaccagaagaatactggggttatgtgactaatggaggaacggagggcaacctgtacggtttgtttttagcgcgtgaacgctttcctacgggcgtcgcctactattcggaagacacgcattatagcgtgtataagaatctgcgtctgctgaacatgcgtcacatcatgatcaaatcacagccgaatggtgagattgattacggcgatctctacgaaactatgcgcattcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgattccttgcggcatcgttttgacacgcaaacattatgtggagcgtattgctcgcagtattgaatatgtcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgcgtcgtaatccatgcgccattaccgttgtgttcccgaaacctccgcagtcagtgctgcacaagtggcaaatcgcagtagagggcgaccgcgcgcatattgtcttaatgccaagtaccaccctccagcatgtcgatgaattgatcgctgacattgcagccgccaataaagcggctgcagcaccgagcgatacgcagaaacccgccgccaagaaacgcccgacaccggctggtgcaccgcaacgtactacgtag

SEQ ID NO: 34 - protein, 406 aa, Artificial Sequence
  Variant of Leucine Decarboxylase from Planctomycetaceae bacterium
MGNLKFPDGALSPHDRRRLEDVYQYVREQCDTFIGYPCNMHFDYTPLLPFLAYPVNNVGDPFAASSYRVHTREIEREVLAWFAELMHIAPEEYWGYVTNGGTEGNLYGLFLARERFPTGVAYYSEDTHYSVYKNLRLLNMRHIMIKSQPNGEIDYGDLYETMRIHRDCPPIIFANIGTTMTEGIDNVRTIQDMFKKLAIHESHIHCDAALAGMTLPFMDDAPAFDFATGIDSLSISGHKFIGSPIPCGIVLTRKHYVERIARSIEYVGTLDTTISGSRNGITPLFLWYAVKQAGRDGFKRRVAACLDNARYTVEQFKRIGVEARRNPCAITVVFPKPPQSVLHKWQIAVEGDRAHIVLMPSTTLQHVDELIADIAAANKAAAAPSDTQKPAAKKRPTPAGAPQRTT

SEQ ID NO: 35 - DNA, 1221 bp, Artificial Sequence
  Variant of Leucine Decarboxylase from Planctomycetaceae bacterium
atgggtaatctgaaatttccagatggcgcgttgagcccgcatgaccgccgccgtctggaagatgtgtatcagtacgttcgtgagcaatgcgacaccttcatcgggtatccggtaaacatgcactttgattacacacctcttttaccgttcctggcctatcccgtcaacaacgtgggcgatccgtttgctgcatccagttatcgcgtgcatacccgtgaaatcgaacgcgaggttctggcgtggttcgccgaactcatgcacattgcaccagaagaatactggggttatgtgactaatggaggaaccgagggcaacctgtacggtttgtttttagcgcgtgaacgctttcctacgggcgtcgcctactattcggaagacacgcattatagcgtgtataagaatctgcgtctgctgaacatgcgtcacatcatgatcaaatcacagccgaatggtgagattgattacggcgatctctacgaaactatgcgcattcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaacattatgtggagcgtattgctcgcagtatcgaatatgtcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgcgtcgtaatccatgcgccattaccgttgtgttcccgaaacctccgcagtcagtgctgcacaagtggcaaatcgcagttaacggcgaccgcgcgcatattgtcttaatgccaagtaccaccctccagcatgtcgatgaattgatcgctgacattgcagccgccaataaagcggctgcagcaccgagcgatacgcagaaacccgccgccaagaaacgcccgacaccggctggtgcaccgcaacgtactacgtag

SEQ ID NO: 36 - protein, 406 aa, Artificial Sequence
  Variant of Leucine Decarboxylase from Planctomycetaceae bacterium
MGNLKFPDGALSPHDRRRLEDVYQYVREQCDTFIGYPVNMHFDYTPLLPFLAYPVNNVGDPFAASSYRVHTREIEREVLAWFAELMHIAPEEYWGYVTNGGTEGNLYGLFLARERFPTGVAYYSEDTHYSVYKNLRLLNMRHIMIKSQPNGEIDYGDLYETMRIHRDCPPIIFANIGTTMTEGIDNVRTIQDMFKKLAIHESHIHCDAALAGMTLPFMDDAPAFDFATGIDSLSISGHKFIGSPMPCGIVLTRKHYVERIARSIEYVGTLDTTISGSRNGITPLFLWYAVKQAGRDGFKRRVAACLDNARYTVEQFKRIGVEARRNPCAITVVFPKPPQSVLHKWQIAVNGDRAHIVLMPSTTLQHVDELIADIAAANKAAAAPSDTQKPAAKKRPTPAGAPQRTT

SEQ ID NO: 37 - DNA, 1221 bp, Artificial Sequence
  Variant of Leucine Decarboxylase from Planctomycetaceae bacterium
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctcttttaccgttcctggcctatcccgtcaacaacgtgggcgatccgtttgctgcatccagttatcgcgtgcatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcattcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaacattatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgcgtcgtaatccatgcgccattaccgttgtgttcccgaaacctccgcagtcagtgctgcacaagtggcaaatcgcaaccgagggcgaccgcgcgcatattatcttaatgccaagtaccaccctccagcatgtcgatgaattgatcgctgacattgcggccgccaataaagcggctgcagcaccgagcgatacgcagaaacccgccgccaagaaacgcccgacaccggctggtgcaccgcaacgtactacgtag

SEQ ID NO: 38 - protein, 406 aa, Artificial Sequence
  Variant of Leucine Decarboxylase from Planctomycetaceae bacterium
MGNLKFPDGALSPTDRRRLEDVYQYVREQCDTFIGYPCNMHFDYTPLLPFLAYPVNNVGDPFAASSYRVHTREIEREVLAWFAELMHIAPEEYWGYVTNGGSEGNLYGLFLARERFPTGVAYYSEDSHYSVYKNLRLLNMRHIMIKSQPNGEIDYGDLYETMRIHRDCPPIIFANIGTTMTEGIDNVRTIQDMFKKLAIHESHIHCDAALAGMTLPFMDDAPAFDFATGIDSLSISGHKFIGSPMPCGIVLTRKHYVERIARSIEYIGTLDTTISGSRNGITPLFLWYAVKQAGRDGFKRRVAACLDNARYTVEQFKRIGVEARRNPCAITVVFPKPPQSVLHKWQIATEGDRAHIILMPSTTLQHVDELIADIAAANKAAAAPSDTQKPAAKKRPTPAGAPQRTT

SEQ ID NO: 39 - DNA, 1221 bp, Artificial Sequence
  Variant of Leucine Decarboxylase from Planctomycetaceae bacterium
atgggtaatctgaaatttccagatggcgcgttgagcccgaccgaccgccgccgtctggaagatgtgtatcagtacgttcgtgagcaatgcgacaccttcctggggtatccggtaaacatgcactttgattacacacctcttttaccgttcctggcctatcccgtcaacaacgtaggcgatccgtttgctgcatccagttatcgcgtgcatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagacacgcattatagcgtgtataagaatctgcgtctgctgaacatgcgtcacatcatgatcaaatcacagccgaatggtgagattgattacggcgatctctacgaaactatgcgcattcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgattccttgcggcatcgttttgacacgcaaacattatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgcgtcgtaatccatgcgccattaccgttgtgttcccgaaacctccgcagtcagtgctgcacaagtggcaaatcgcagtagagggcgaccgcgcgcatattgtcttaatgccaagtaccaccctccagcatgtcgatgaattgatcgctgacattgcagccgccaataaagcggctgcagcaccgagcgatacgcagaaacccgccgccaagaaacgcccgacaccggctggtgcaccgcaacgtactacgtag

SEQ ID NO: 40 - protein, 406 aa, Artificial Sequence
  Variant of Leucine Decarboxylase from Planctomycetaceae bacterium
MGNLKFPDGALSPTDRRRLEDVYQYVREQCDTFLGYPVNMHFDYTPLLPFLAYPVNNVGDPFAASSYRVHTREIEREVLAWFAELMHIAPEEYWGYVTNGGSEGNLYGLFLARERFPTGVAYYSEDTHYSVYKNLRLLNMRHIMIKSQPNGEIDYGDLYETMRIHRDCPPIIFANIGTTMTEGIDNVRTIQDMFKKLAIHESHIHCDAALAGMTLPFMDDAPAFDFATGIDSLSISGHKFIGSPIPCGIVLTRKHYVERIARSIEYIGTLDTTISGSRNGITPLFLWYAVKQAGRDGFKRRVAACLDNARYTVEQFKRIGVEARRNPCAITVVFPKPPQSVLHKWQIAVEGDRAHIVLMPSTTLQHVDELIADIAAANKAAAAPSDTQKPAAKKRPTPAGAPQRTT

SEQ ID NO: 41 - DNA, 1221 bp, Artificial Sequence
  Variant of Leucine Decarboxylase from Planctomycetaceae bacterium
atgggtaatctgaaatttccagatggcgcgttgagcccgcatgaccgccgccgtctggaagatgtgtatcagtacgttcgtgagcaatgcgacaccttcatcgggtatccggtaaacatgcactttgattacacacctcttttaccgttcctggcctatcccgtcaacaacgtgggcgatccgtttgctgcatccagttatcgcgtgcatacccgtgaaatcgaacgcgaggttctggcgtggttcgccgaactcatgcacattgcaccagaagaatactggggttatgtgactaatggaggaaccgagggcaacctgtacggtttgtttttagcgcgtgaacgctttcctacgggcgtcgcctactattcggaagacacgcattatagcgtgtataagaatctgcgtctgctgaacatgcgtcacatcatgatcaaatcacagccgaatggtgagattgattacggcgatctctacgaaactatgcgcattcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgattccttgcggcatcgttttgacacgcaaacattatgtggagcgtattgctcgcagtgttgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgcgtcgtaatccatgcgccattaccgttgtgttcccgaaacctccgcagtcagtgctgcacaagtggcaaatcgcagtagagggcgaccgcgcgcatattatcttaatgccaagtaccaccctccagcatgtcgatgaattgatcgctgacattgcagccgccaataaagcggctgcagcaccgagcgatacgcagaaacccgccgccaagaaacgcccgacaccggctggtgcaccgcaacgtactacgtag

SEQ ID NO: 42 - protein, 406 aa, Artificial Sequence
  Variant of Leucine Decarboxylase from Planctomycetaceae bacterium
MGNLKFPDGALSPHDRRRLEDVYQYVREQCDTFIGYPVNMHFDYTPLLPFLAYPVNNVGDPFAASSYRVHTREIEREVLAWFAELMHIAPEEYWGYVTNGGTEGNLYGLFLARERFPTGVAYYSEDTHYSVYKNLRLLNMRHIMIKSQPNGEIDYGDLYETMRIHRDCPPIIFANIGTTMTEGIDNVRTIQDMFKKLAIHESHIHCDAALAGMTLPFMDDAPAFDFATGIDSLSISGHKFIGSPIPCGIVLTRKHYVERIARSVEYIGTLDTTISGSRNGITPLFLWYAVKQAGRDGFKRRVAACLDNARYTVEQFKRIGVEARRNPCAITVVFPKPPQSVLHKWQIAVEGDRAHIILMPSTTLQHVDELIADIAAANKAAAAPSDTQKPAAKKRPTPAGAPQRTT

SEQ ID NO: 43 - DNA, 1221 bp, Artificial Sequence
  Variant of Leucine Decarboxylase from Planctomycetaceae bacterium
atgggtaatctgaaatttccagatggcgcgttgagcccgcatgaccgccgccgtctggaagatgtgtatcagtacgttcgtgagcaatgcgacaccttcatcgggtatccggtaaacatgcactttgattacacacctcttttaccgttcctggcctatcccgtcaacaacgtgggcgatccgtttgctgcatccagttatcgcgtgcatacccgtgaaatcgaacgcgaggttctggcgtggttcgccgaactcatgcacattgcaccagaagaatactggggttatgtgactaatggaggaacggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcattcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgattccttgcggcatcgttttgacacgcaaacattatgtggagcgtattgctcgcagtgttgaatatgtcggtaccctggacactacgattacgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgcgtcgtaatccatgcgccattaccgttgtgttcccgaaacctccgcagtcagtgctgcacaagtggcaaatcgcagtagagggcgaccgcgcgcatattgtcttaatgccaagtaccaccctccagcatgtcgatgaattgatcgctgacattgcagccgccaataaagcggctgcagcaccgagcgatacgcagaaacccgccgccaagaaacgcccgacaccggctggtgcaccgcaacgtactacgtag

SEQ ID NO: 44 - protein, 406 aa, Artificial Sequence
  Variant of Leucine Decarboxylase from Planctomycetaceae bacterium
MGNLKFPDGALSPHDRRRLEDVYQYVREQCDTFIGYPVNMHFDYTPLLPFLAYPVNNVGDPFAASSYRVHTREIEREVLAWFAELMHIAPEEYWGYVTNGGTEGNLYGLFLARERFPTGVAYYSEDSHYSVYKNLRLLNMRHIMIKSQPNGEIDYGDLYETMRIHRDCPPIIFANIGTTMTEGIDNVRTIQDMFKKLAIHESHIHCDAALAGMTLPFMDDAPAFDFATGIDSLSISGHKFIGSPIPCGIVLTRKHYVERIARSVEYVGTLDTTITGSRNGITPLFLWYAVKQAGRDGFKRRVAACLDNARYTVEQFKRIGVEARRNPCAITVVFPKPPQSVLHKWQIAVEGDRAHIVLMPSTTLQHVDELIADIAAANKAAAAPSDTQKPAAKKRPTPAGAPQRTT

SEQ ID NO: 45 - DNA, 1221 bp, Artificial Sequence
  Variant of Leucine Decarboxylase from Planctomycetaceae bacterium
atgggtaatctgaaatttccagatggcgcgttgagcccgcatgaccgccgccgtctggaagatgtgtatcagtacgttcgtgagcaatgcgacaccttcatcgggtatccggtaaacatgcactttgattacacacctcttttaccgttcctggcctatcccgtcaacaacgtgggcgatccgtttgctgcatccagttatcgcgtgcatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcattcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgattccttgcggcatcgttttgacacgcaaacattatgtggagcgtattgctcgcagtatcgaatatgtcggtaccctggacactacgattacgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgcgtcgtaatccatgcgccattaccgttgtgttcccgaaacctccgcagtcagtgctgcacaagtggcaaatcgcagtagagggcgaccgcgcgcatattatcttaatgccaagtaccaccctccagcatgtcgatgaattgatcgctgacattgcagccgccaataaagcggctgcagcaccgagcgatacgcagaaacctgccgccaagaaacgcccgacaccggctggtgcaccgcaacgtactacgtag

SEQ ID NO: 46 - protein, 406 aa, Artificial Sequence
  Variant of Leucine Decarboxylase from Planctomycetaceae bacterium
MGNLKFPDGALSPHDRRRLEDVYQYVREQCDTFIGYPVNMHFDYTPLLPFLAYPVNNVGDPFAASSYRVHTREIEREVLAWFAELMHIAPEEYWGYVTNGGSEGNLYGLFLARERFPTGVAYYSEDSHYSVYKNLRLLNMRHIMIKSQPNGEIDYGDLYETMRIHRDCPPIIFANIGTTMTEGIDNVRTIQDMFKKLAIHESHIHCDAALAGMTLPFMDDAPAFDFATGIDSLSISGHKFIGSPIPCGIVLTRKHYVERIARSIEYVGTLDTTITGSRNGITPLFLWYAVKQAGRDGFKRRVAACLDNARYTVEQFKRIGVEARRNPCAITVVFPKPPQSVLHKWQIAVEGDRAHIILMPSTTLQHVDELIADIAAANKAAAAPSDTQKPAAKKRPTPAGAPQRTT

SEQ ID NO: 47 - DNA, 1221 bp, Artificial Sequence
  Variant of Leucine Decarboxylase from Planctomycetaceae bacterium
atgggtaatctgaaatttccagatggcgcgttgagcccgcatgaccgccgccgtctggaagatgtgtatcagtacgttcgtgagcaatgcgacaccttcctggggtatccggtaaacatgcactttgattacacacctcttttaccgttcctggcctatcccgtcaacaacgtgggcgatccgtttgctgcatccagttatcgcgtgcatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcattcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgattccttgcggcatcgttttgacacgcaaacattatgtggagcgtattgctcgcagtatcgaatatgtcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgcgtcgtaatccatgcgccattaccgttgtgttcccgaaacctccgcagtcagtgctgcacaagtggcaaatcgcagtaaatggcgaccgcgcgcatattgtcttaatgccaagtaccaccctccagcatgtcgatgaattgatcgctgacattgcagccgccaataaagcggctgcagcaccgagcgatacgcagaaacccgccgccaagaaacgcccgacaccggctggtgcaccgcaacgtactacgtag

SEQ ID NO: 48 - protein, 406 aa, Artificial Sequence
  Variant of Leucine Decarboxylase from Planctomycetaceae bacterium
MGNLKFPDGALSPHDRRRLEDVYQYVREQCDTFLGYPVNMHFDYTPLLPFLAYPVNNVGDPFAASSYRVHTREIEREVLAWFAELMHIAPEEYWGYVTNGGSEGNLYGLFLARERFPTGVAYYSEDSHYSVYKNLRLLNMRHIMIKSQPNGEIDYGDLYETMRIHRDCPPIIFANIGTTMTEGIDNVRTIQDMFKKLAIHESHIHCDAALAGMTLPFMDDAPAFDFATGIDSLSISGHKFIGSPIPCGIVLTRKHYVERIARSIEYVGTLDTTISGSRNGITPLFLWYAVKQAGRDGFKRRVAACLDNARYTVEQFKRIGVEARRNPCAITVVFPKPPQSVLHKWQIAVNGDRAHIVLMPSTTLQHVDELIADIAAANKAAAAPSDTQKPAAKKRPTPAGAPQRTT

SEQ ID NO: 49 - DNA, 1221 bp, Artificial Sequence
  Variant of Leucine Decarboxylase from Planctomycetaceae bacterium
atgggtaatctgaaatttccagatggcgcgttgagcccgcatgaccgccgccgtctggaagatgtgtatcagtacgttcgtgagcaatgcgacaccttcatcgggtatccgtgcaacatgcactttgattacacacctcttttaccgttcctggcctatcccgtcaacaacgtgggcgatccgtttgctgcatccagttatcgcgtgcatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcattcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgattccttgcggcatcgttttgacacgcaaacattatgtggagcgtattgctcgcagtgttgaatatgtcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgcgtcgtaatccatgcgccattaccgttgtgttcccgaaacctccgcagtcagtgctgcacaagtggcaaatcgcagttaacggcgaccgcgcgcatattgtcttaatgccaagtaccaccctccagcatgtcgatgaattgatcgctgacattgcagccgccaataaagcggctgcagcaccgagcgatacgcagaaacccgccgccaagaaacgcccgacaccggctggtgcaccgcaacgtactacgtag

SEQ ID NO: 50 - protein, 406 aa, Artificial Sequence
  Variant of Leucine Decarboxylase from Planctomycetaceae bacterium
MGNLKFPDGALSPHDRRRLEDVYQYVREQCDTFIGYPCNMHFDYTPLLPFLAYPVNNVGDPFAASSYRVHTREIEREVLAWFAELMHIAPEEYWGYVTNGGSEGNLYGLFLARERFPTGVAYYSEDSHYSVYKNLRLLNMRHIMIKSQPNGEIDYGDLYETMRIHRDCPPIIFANIGTTMTEGIDNVRTIQDMFKKLAIHESHIHCDAALAGMTLPFMDDAPAFDFATGIDSLSISGHKFIGSPIPCGIVLTRKHYVERIARSVEYVGTLDTTISGSRNGITPLFLWYAVKQAGRDGFKRRVAACLDNARYTVEQFKRIGVEARRNPCAITVVFPKPPQSVLHKWQIAVNGDRAHIVLMPSTTLQHVDELIADIAAANKAAAAPSDTQKPAAKKRPTPAGAPQRTT

SEQ ID NO: 51 - DNA, 1221 bp, Artificial Sequence
  Variant of Leucine Decarboxylase from Planctomycetaceae bacterium
atgggtaatctgaaatttccagatggcgcgttgagcccgcatgaccgccgccgtctggaagatgtgtatcagtacgttcgtgagcaatgcgacaccttcatcgggtatccggtaaacatgcactttgattacacacctcttttaccgttcctggcctatcccgtcaacaacgtgggcgatccgtttgctgcatccagttatcgcgtgcatacccgtgaaatcgaacgcgaggttctggcgtggttcgccgaactcatgcacattgcaccagaagaatactggggttatgtgactaatggaggaacggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcattcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgattccttgcggcatcgttttgacacgcaaacattatgtggagcgtattgctcgcagtatcgaatatgtcggtaccctggacactacgattaccggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgcgtcgtaatccatgcgccattaccgttgtgttcccgaaacctccgcagtcagtgctgcacaagtggcaaatcgcagtagagggcgaccgcgcgcatattgtcttaatgccaagtaccaccctccagcatgtcgatgaattgatcgctgacattgcagccgccaataaagcggctgcagcaccgagcgatacgcagaaacccgccgccaagaaacgcccgacaccggctggtgcaccgcaacgtactacgtag

SEQ ID NO: 52 - protein, 406 aa, Artificial Sequence
  Variant of Leucine Decarboxylase from Planctomycetaceae bacterium
MGNLKFPDGALSPHDRRRLEDVYQYVREQCDTFIGYPVNMHFDYTPLLPFLAYPVNNVGDPFAASSYRVHTREIEREVLAWFAELMHIAPEEYWGYVTNGGTEGNLYGLFLARERFPTGVAYYSEDSHYSVYKNLRLLNMRHIMIKSQPNGEIDYGDLYETMRIHRDCPPIIFANIGTTMTEGIDNVRTIQDMFKKLAIHESHIHCDAALAGMTLPFMDDAPAFDFATGIDSLSISGHKFIGSPIPCGIVLTRKHYVERIARSIEYVGTLDTTITGSRNGITPLFLWYAVKQAGRDGFKRRVAACLDNARYTVEQFKRIGVEARRNPCAITVVFPKPPQSVLHKWQIAVEGDRAHIVLMPSTTLQHVDELIADIAAANKAAAAPSDTQKPAAKKRPTPAGAPQRTT

SEQ ID NO: 53 - DNA, 1221 bp, Artificial Sequence
  Variant of Leucine Decarboxylase from Planctomycetaceae bacterium
atgggtaatctgaaatttccagatggcgcgttgagcccgcatgaccgccgccgtctggaagatgtgtatcagtacgttcgtgagcaatgcgacaccttcctggggtatccgtgcaacatgcactttgattacacacctcttttaccgttcctggcctatcccgtcaacaacgtgggcgatccgtttgctgcatccagttatcgcgtgcatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcattcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgattccttgcggcatcgttttgacacgcaaacattatgtggagcgtattgctcgcagtgttgaatatgtcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgcgtcgtaatccatgcgccattaccgttgtgttcccgaaacctccgcagtcagtgctgcacaagtggcaaatcgcagtaaatggcgaccgcgcgcatattgtcttaatgccaagtaccaccctccagcatgtcgatgaattgatcgctgacattgcagccgccaataaagcggctgcagcaccgagcgatacgcagaaacccgccgccaagaaacgcccgacaccggctggtgcaccgcaacgtactacgtag

SEQ ID NO: 54 - protein, 406 aa, Artificial Sequence
  Variant of Leucine Decarboxylase from Planctomycetaceae bacterium
MGNLKFPDGALSPHDRRRLEDVYQYVREQCDTFLGYPCNMHFDYTPLLPFLAYPVNNVGDPFAASSYRVHTREIEREVLAWFAELMHIAPEEYWGYVTNGGSEGNLYGLFLARERFPTGVAYYSEDSHYSVYKNLRLLNMRHIMIKSQPNGEIDYGDLYETMRIHRDCPPIIFANIGTTMTEGIDNVRTIQDMFKKLAIHESHIHCDAALAGMTLPFMDDAPAFDFATGIDSLSISGHKFIGSPIPCGIVLTRKHYVERIARSVEYVGTLDTTISGSRNGITPLFLWYAVKQAGRDGFKRRVAACLDNARYTVEQFKRIGVEARRNPCAITVVFPKPPQSVLHKWQIAVNGDRAHIVLMPSTTLQHVDELIADIAAANKAAAAPSDTQKPAAKKRPTPAGAPQRTT

SEQ ID NO: 55 - DNA, 1221 bp, Artificial Sequence
  Variant of Leucine Decarboxylase from Planctomycetaceae bacterium
atgggtaatctgaaatttccagatggcgcgttgagcccgcatgaccgccgccgtctggaagatgtgtatcagtacgttcgtgagcaatgcgacaccttcatcgggtatccggtaaacatgcactttgattacacacctcttttaccgttcctggcctatcccgtcaacaacgtgggcgatccgtttgctgcatccagttatcgcgtgcatacccgtgaaatcgaacgcgaggttctggcgtggttcgccgaactcatgcacattgcaccagaagaatactggggttatgtgactaatggaggaaccgagggcaacctgtacggtttgtttttagcgcgtgaacgctttcctacgggcgtcgcctactattcggaagacacgcattatagcgtgtataagaatctgcgtctgctgaacatgcgtcacatcatgatcaaatcacagccgaatggtgagattgattacggcgatctctacgaaactatgcgcattcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgattccttgcggcatcgttttgacacgcaaacattatgtggagcgtattgctcgcagtattgaatatgtcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgcgtcgtaatccatgcgccattaccgttgtgttcccgaaacctccgcagtcagtgctgcacaagtggcaaatcgcagtagagggcgaccgcgcgcatattatcttaatgccaagtaccaccctccagcatgtcgatgaattgatcgctgacattgcagccgccaataaagcggctgcagcaccgagcgatacgcagaaacccgccgccaagaaacgcccgacaccggctggtgcaccgcaacgtactacgtag

SEQ ID NO: 56 - protein, 406 aa, Artificial Sequence
  Variant of Leucine Decarboxylase from Planctomycetaceae bacterium
MGNLKFPDGALSPHDRRRLEDVYQYVREQCDTFIGYPVNMHFDYTPLLPFLAYPVNNVGDPFAASSYRVHTREIEREVLAWFAELMHIAPEEYWGYVTNGGTEGNLYGLFLARERFPTGVAYYSEDTHYSVYKNLRLLNMRHIMIKSQPNGEIDYGDLYETMRIHRDCPPIIFANIGTTMTEGIDNVRTIQDMFKKLAIHESHIHCDAALAGMTLPFMDDAPAFDFATGIDSLSISGHKFIGSPIPCGIVLTRKHYVERIARSIEYVGTLDTTISGSRNGITPLFLWYAVKQAGRDGFKRRVAACLDNARYTVEQFKRIGVEARRNPCAITVVFPKPPQSVLHKWQIAVEGDRAHIILMPSTTLQHVDELIADIAAANKAAAAPSDTQKPAAKKRPTPAGAPQRTT

SEQ ID NO: 57 - DNA, 1221 bp, Artificial Sequence
  Variant of Leucine Decarboxylase from Planctomycetaceae bacterium
atgggtaatctgaaatttccagatggcgcgttgagcccgcatgaccgccgccgtctggaagatgtgtatcagtacgttcgtgagcaatgcgacaccttcatcgggtatccggtaaacatgcactttgattacacacctcttttaccgttcctggcctatcccgtcaacaacgtgggcgatccgtttgctgcatccagttatcgcgtgcatacccgtgaaatcgaacgcgaggttctggcgtggttcgccgaactcatgcacattgcaccagaagaatactggggttatgtgactaatggaggaacggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcattcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaacattatgtggagcgtattgctcgcagtattgaatatatcggtaccctggacactacgattacgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgcgtcgtaatccatgcgccattaccgttgtgttcccgaaacctccgcagtcagtgctgcacaagtggcaaatcgcagttaacggcgaccgcgcgcatattgtcttaatgccaagtaccaccctccagcatgtcgatgaattgatcgctgacattgcagccgccaataaagcggctgcagcaccgagcgatacgcagaaacccgccgccaagaaacgcccgacaccggctggtgcaccgcaacgtactacgtag

SEQ ID NO: 58 - protein, 406 aa, Artificial Sequence
  Variant of Leucine Decarboxylase from Planctomycetaceae bacterium
MGNLKFPDGALSPHDRRRLEDVYQYVREQCDTFIGYPVNMHFDYTPLLPFLAYPVNNVGDPFAASSYRVHTREIEREVLAWFAELMHIAPEEYWGYVTNGGTEGNLYGLFLARERFPTGVAYYSEDSHYSVYKNLRLLNMRHIMIKSQPNGEIDYGDLYETMRIHRDCPPIIFANIGTTMTEGIDNVRTIQDMFKKLAIHESHIHCDAALAGMTLPFMDDAPAFDFATGIDSLSISGHKFIGSPMPCGIVLTRKHYVERIARSIEYIGTLDTTITGSRNGITPLFLWYAVKQAGRDGFKRRVAACLDNARYTVEQFKRIGVEARRNPCAITVVFPKPPQSVLHKWQIAVNGDRAHIVLMPSTTLQHVDELIADIAAANKAAAAPSDTQKPAAKKRPTPAGAPQRTT

SEQ ID NO: 59 - DNA, 1221 bp, Artificial Sequence
  Variant of Leucine Decarboxylase from Planctomycetaceae bacterium
atgggtaatctgaaatttccagatggcgcgttgagcccgcatgaccgccgccgtctggaagatgtgtatcagtacgttcgtgagcaatgcgacaccttcattgggtatccggtaaacatgcactttgattacacacctcttttaccgttcctggcctatcccgtcaacaacgtgggcgatccgtttgctgcatccagttatcgcgtgcatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcattcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgattccttgcggcatcgttttgacacgcaaacattatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgcgtcgtaatccatgcgccattaccgttgtgttcccgaaacctccgcagtcagtgctgcacaagtggcaaatcgcaaccgagggcgaccgcgcgcatattgtcttaatgccaagtaccaccctccagcatgtcgatgaattgatcgctgacattgcagccgccaataaagcggctgcagcaccgagcgatacgcagaaacccgccgccaagaaacgcccgacaccggctggtgcaccgcaacgtactacgtag

SEQ ID NO: 60 - protein, 406 aa, Artificial Sequence
  Variant of Leucine Decarboxylase from Planctomycetaceae bacterium
MGNLKFPDGALSPHDRRRLEDVYQYVREQCDTFIGYPVNMHFDYTPLLPFLAYPVNNVGDPFAASSYRVHTREIEREVLAWFAELMHIAPEEYWGYVTNGGSEGNLYGLFLARERFPTGVAYYSEDSHYSVYKNLRLLNMRHIMIKSQPNGEIDYGDLYETMRIHRDCPPIIFANIGTTMTEGIDNVRTIQDMFKKLAIHESHIHCDAALAGMTLPFMDDAPAFDFATGIDSLSISGHKFIGSPIPCGIVLTRKHYVERIARSIEYIGTLDTTISGSRNGITPLFLWYAVKQAGRDGFKRRVAACLDNARYTVEQFKRIGVEARRNPCAITVVFPKPPQSVLHKWQIATEGDRAHIVLMPSTTLQHVDELIADIAAANKAAAAPSDTQKPAAKKRPTPAGAPQRTT

SEQ ID NO: 61 - DNA, 1221 bp, Artificial Sequence
  Variant of Leucine Decarboxylase from Planctomycetaceae bacterium
atgggtaatctgaaatttccagatggcgcgttgagcccgcatgaccgccgccgtctggaagatgtgtatcagtacgttcgtgagcaatgcgacaccttcatcgggtatccggtaaacatgcactttgattacacacctcttttaccgttcctggcctatcccgtcaacaacgtgggcgatccgtttgctgcatccagttatcgcgtgcatacccgtgaaatcgaacgcgaggttctggcgtggttcgccgaactcatgcacattgcaccagaagaatactggggttatgtgactaatggaggaaccgagggcaacctgtacggtttgtttttagcgcgtgaacgctttcctacgggcgtcgcctactattcggaagacacgcattatagcgtgtataagaatctgcgtctgctgaacatgcgtcacatcatgatcaaatcacagccgaatggtgagattgattacggcgatctctacgaaactatgcgcattcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgattccttgcggcatcgttttgacacgcaaacattatgtggagcgtattgctcgcagtatcgaatatgtcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgcgtcgtaatccatgcgccattaccgttgtgttcccgaaacctccgcagtcagtgctgcacaagtggcaaatcgcagtaaatggcgaccgcgcgcatattatcttaatgccaagtaccaccctccagcatgtcgatgaattgatcgctgacattgcagccgccaataaagcggctgcagcaccgagcgatacgcagaaacccgccgccaagaaacgcccgacaccggctggtgcaccgcaacgtactacgtag

SEQ ID NO: 62 - protein, 406 aa, Artificial Sequence
  Variant of Leucine Decarboxylase from Planctomycetaceae bacterium
MGNLKFPDGALSPHDRRRLEDVYQYVREQCDTFIGYPVNMHFDYTPLLPFLAYPVNNVGDPFAASSYRVHTREIEREVLAWFAELMHIAPEEYWGYVTNGGTEGNLYGLFLARERFPTGVAYYSEDTHYSVYKNLRLLNMRHIMIKSQPNGEIDYGDLYETMRIHRDCPPIIFANIGTTMTEGIDNVRTIQDMFKKLAIHESHIHCDAALAGMTLPFMDDAPAFDFATGIDSLSISGHKFIGSPIPCGIVLTRKHYVERIARSIEYVGTLDTTISGSRNGITPLFLWYAVKQAGRDGFKRRVAACLDNARYTVEQFKRIGVEARRNPCAITVVFPKPPQSVLHKWQIAVNGDRAHIILMPSTTLQHVDELIADIAAANKAAAAPSDTQKPAAKKRPTPAGAPQRTT

SEQ ID NO: 63 - DNA, 1221 bp, Artificial Sequence
  Variant of Leucine Decarboxylase from Planctomycetaceae bacterium
atgggtaatctgaaatttccagatggcgcgttgagcccgcatgaccgccgccgtctggaagatgtgtatcagtacgttcgtgagcaatgcgacaccttcatcgggtatccgtgcaacatgcactttgattacacacctcttttaccgttcctggcctatcccgtcaacaacgtaggcgatccgtttgctgcatccagttatcgcgtgcatacccgtgaaatcgaacgcgaggttctggcgtggttcgccgaactcatgcacattgcaccagaagaatactggggttatgtgactaatggaggaaccgagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcattcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgattccttgcggcatcgttttgacacgcaaacattatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgcgtcgtaatccatgcgccattaccgttgtgttcccgaaacctccgcagtcagtgctgcacaagtggcaaatcgcagtagagggcgaccgcgcgcatattgtcttaatgccaagtaccaccctccagcatgtcgatgaattgatcgctgacattgcagccgccaataaagcggctgcagcaccgagcgatacgcagaaacccgccgccaagaaacgcccgacaccggctggtgcaccgcaacgtactacgtag

SEQ ID NO: 64 - protein, 406 aa, Artificial Sequence
  Variant of Leucine Decarboxylase from Planctomycetaceae bacterium
MGNLKFPDGALSPHDRRRLEDVYQYVREQCDTFIGYPCNMHFDYTPLLPFLAYPVNNVGDPFAASSYRVHTREIEREVLAWFAELMHIAPEEYWGYVTNGGTEGNLYGLFLARERFPTGVAYYSEDSHYSVYKNLRLLNMRHIMIKSQPNGEIDYGDLYETMRIHRDCPPIIFANIGTTMTEGIDNVRTIQDMFKKLAIHESHIHCDAALAGMTLPFMDDAPAFDFATGIDSLSISGHKFIGSPIPCGIVLTRKHYVERIARSIEYIGTLDTTISGSRNGITPLFLWYAVKQAGRDGFKRRVAACLDNARYTVEQFKRIGVEARRNPCAITVVFPKPPQSVLHKWQIAVEGDRAHIVLMPSTTLQHVDELIADIAAANKAAAAPSDTQKPAAKKRPTPAGAPQRTT

SEQ ID NO: 65 - DNA, 1221 bp, Artificial Sequence
  Variant of Leucine Decarboxylase from Planctomycetaceae bacterium
atgggtaatctgaaatttccagatggcgcgttgagcccgcatgaccgccgccgtctggaagatgtgtatcagtacgttcgtgagcaatgcgacaccttcattgggtatccgtgcaacatgcactttgattacacacctcttttaccgttcctggcctatcccgtcaacaacgtgggcgatccgtttgctgcatccagttatcgcgtgcatacccgtgaaatcgaacgcgaggttctggcgtggttcgccgaactcatgcacattgcaccagaagaatactggggttatgtgactaatggaggaacggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcattcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgattccttgcggcatcgttttgacacgcaaacattatgtggagcgtattgctcgcagtattgaatatatcggtaccctggacactacgattacgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgcgtcgtaatccatgcgccattaccgttgtgttcccgaaacctccgcagtcagtgctgcacaagtggcaaatcgcagtagagggcgaccgcgcgcatattgtcttaatgccaagtaccaccctccagcatgtcgatgaattgatcgctgacattgcagccgccaataaagcggctgcagcaccgagcgatacgcagaaacccgccgccaagaaacgcccgacaccggctggtgcaccgcaacgtactacgtag

SEQ ID NO: 66 - protein, 406 aa, Artificial Sequence
  Variant of Leucine Decarboxylase from Planctomycetaceae bacterium
MGNLKFPDGALSPHDRRRLEDVYQYVREQCDTFIGYPCNMHFDYTPLLPFLAYPVNNVGDPFAASSYRVHTREIEREVLAWFAELMHIAPEEYWGYVTNGGTEGNLYGLFLARERFPTGVAYYSEDSHYSVYKNLRLLNMRHIMIKSQPNGEIDYGDLYETMRIHRDCPPIIFANIGTTMTEGIDNVRTIQDMFKKLAIHESHIHCDAALAGMTLPFMDDAPAFDFATGIDSLSISGHKFIGSPIPCGIVLTRKHYVERIARSIEYIGTLDTTITGSRNGITPLFLWYAVKQAGRDGFKRRVAACLDNARYTVEQFKRIGVEARRNPCAITVVFPKPPQSVLHKWQIAVEGDRAHIVLMPSTTLQHVDELIADIAAANKAAAAPSDTQKPAAKKRPTPAGAPQRTT

SEQ ID NO: 67 - DNA, 1221 bp, Artificial Sequence
  Variant of Leucine Decarboxylase from Planctomycetaceae bacterium
atgggtaatctgaaatttccagatggcgcgttgagcccgcatgaccgccgccgtctggaagatgtgtatcagtacgttcgtgagcaatgcgacaccttcctggggtatccggtaaacatgcactttgattacacacctcttttaccgttcctggcctatcccgtcaacaacgtgggcgatccgtttgctgcatccagttatcgcgtgcatacccgtgaaatcgaacgcgaggttctggcgtggttcgccgaactcatgcacattgcaccagaagaatactggggttatgtgactaatggaggaacggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcattcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaacattatgtggagcgtattgctcgcagtatcgaatatgtcggtaccctggacactacgattaccggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgcgtcgtaatccatgcgccattaccgttgtgttcccgaaacctccgcagtcagtgctgcacaagtggcaaatcgcaaccgagggcgaccgcgcgcatattgtcttaatgccaagtaccaccctccagcatgtcgatgaattgatcgctgacattgcagccgccaataaagcggctgcagcaccgagcgatacgcagaaacccgccgccaagaaacgcccgacaccggctggtgcaccgcaacgtactacgtag

SEQ ID NO: 68 - protein, 406 aa, Artificial Sequence
  Variant of Leucine Decarboxylase from Planctomycetaceae bacterium
MGNLKFPDGALSPHDRRRLEDVYQYVREQCDTFLGYPVNMHFDYTPLLPFLAYPVNNVGDPFAASSYRVHTREIEREVLAWFAELMHIAPEEYWGYVTNGGTEGNLYGLFLARERFPTGVAYYSEDSHYSVYKNLRLLNMRHIMIKSQPNGEIDYGDLYETMRIHRDCPPIIFANIGTTMTEGIDNVRTIQDMFKKLAIHESHIHCDAALAGMTLPFMDDAPAFDFATGIDSLSISGHKFIGSPMPCGIVLTRKHYVERIARSIEYVGTLDTTITGSRNGITPLFLWYAVKQAGRDGFKRRVAACLDNARYTVEQFKRIGVEARRNPCAITVVFPKPPQSVLHKWQIATEGDRAHIVLMPSTTLQHVDELIADIAAANKAAAAPSDTQKPAAKKRPTPAGAPQRTT

SEQ ID NO: 69 - DNA, 1221 bp, Artificial Sequence
  Variant of Leucine Decarboxylase from Planctomycetaceae bacterium
atgggtaatctgaaatttccagatggcgcgttgagcccgcatgaccgccgccgtctggaagatgtgtatcagtacgttcgtgagcaatgcgacaccttcctggggtatccgtgcaacatgcactttgattacacacctcttttaccgttcctggcctatcccgtcaacaacgtgggcgatccgtttgctgcatccagttatcgcgtgcatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcattcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgattccttgcggcatcgttttgacacgcaaacattatgtggagcgtattgctcgcagtatcgaatatgtcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgcgtcgtaatccatgcgccattaccgttgtgttcccgaaacctccgcagtcagtgctgcacaagtggcaaatcgcaaccaatggcgaccgcgcgcatattgtcttaatgccaagtaccaccctccagcatgtcgatgaattgatcgctgacattgcagccgccaataaagcggctgcagcaccgagcgatacgcagaaacccgccgccaagaaacgcccgacaccggctggtgcaccgcaacgtactacgtag

SEQ ID NO: 70 - protein, 406 aa, Artificial Sequence
  Variant of Leucine Decarboxylase from Planctomycetaceae bacterium
MGNLKFPDGALSPHDRRRLEDVYQYVREQCDTFLGYPCNMHFDYTPLLPFLAYPVNNVGDPFAASSYRVHTREIEREVLAWFAELMHIAPEEYWGYVTNGGSEGNLYGLFLARERFPTGVAYYSEDSHYSVYKNLRLLNMRHIMIKSQPNGEIDYGDLYETMRIHRDCPPIIFANIGTTMTEGIDNVRTIQDMFKKLAIHESHIHCDAALAGMTLPFMDDAPAFDFATGIDSLSISGHKFIGSPIPCGIVLTRKHYVERIARSIEYVGTLDTTISGSRNGITPLFLWYAVKQAGRDGFKRRVAACLDNARYTVEQFKRIGVEARRNPCAITVVFPKPPQSVLHKWQIATNGDRAHIVLMPSTTLQHVDELIADIAAANKAAAAPSDTQKPAAKKRPTPAGAPQRTT

SEQ ID NO: 71 - DNA, 1221 bp, Artificial Sequence
  Variant of Leucine Decarboxylase from Planctomycetaceae bacterium
atgggtaatctgaaatttccagatggcgcgttgagcccgcatgaccgccgccgtctggaagatgtgtatcagtacgttcgtgagcaatgcgacaccttcatcgggtatccggtaaacatgcactttgattacacacctcttttaccgttcctggcctatcccgtcaacaacgtgggcgatccgtttgctgcatccagttatcgcgtgcatacccgtgaaatcgaacgcgaggttctggcgtggttcgccgaactcatgcacattgcaccagaagaatactggggttatgtgactaatggaggaaccgagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcattcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgattccttgcggcatcgttttgacacgcaaacattatgtggagcgtattgctcgcagtattgaatatgtcggtaccctggacactacgattacgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgcgtcgtaatccatgcgccattaccgttgtgttcccgaaacctccgcagtcagtgctgcacaagtggcaaatcgcagtaaatggcgaccgcgcgcatattgtcttaatgccaagtaccaccctccagcatgtcgatgaattgatcgctgacattgcagccgccaataaagcggctgcagcaccgagcgatacgcagaaacccgccgccaagaaacgcccgacaccggctggtgcaccgcaacgtactacgtag

SEQ ID NO: 72 - protein, 406 aa, Artificial Sequence
  Variant of Leucine Decarboxylase from Planctomycetaceae bacterium
MGNLKFPDGALSPHDRRRLEDVYQYVREQCDTFIGYPVNMHFDYTPLLPFLAYPVNNVGDPFAASSYRVHTREIEREVLAWFAELMHIAPEEYWGYVTNGGTEGNLYGLFLARERFPTGVAYYSEDSHYSVYKNLRLLNMRHIMIKSQPNGEIDYGDLYETMRIHRDCPPIIFANIGTTMTEGIDNVRTIQDMFKKLAIHESHIHCDAALAGMTLPFMDDAPAFDFATGIDSLSISGHKFIGSPIPCGIVLTRKHYVERIARSIEYVGTLDTTITGSRNGITPLFLWYAVKQAGRDGFKRRVAACLDNARYTVEQFKRIGVEARRNPCAITVVFPKPPQSVLHKWQIAVNGDRAHIVLMPSTTLQHVDELIADIAAANKAAAAPSDTQKPAAKKRPTPAGAPQRTT

SEQ ID NO: 73 - DNA, 1221 bp, Artificial Sequence
  Variant of Leucine Decarboxylase from Planctomycetaceae bacterium
atgggtaatctgaaatttccagatggcgcgttgagcccgcatgaccgccgccgtctggaagatgtgtatcagtacgttcgtgagcaatgcgacaccttcctggggtatccgtgcaacatgcactttgattacacacctcttttaccgttcctggcctatcccgtcaacaacgtgggcgatccgtttgctgcatccagttatcgcgtgcatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagacacgcattatagcgtgtataagaatctgcgtctgctgaacatgcgtcacatcatgatcaaatcacagccgaatggtgagattgattacggcgatctctacgaaactatgcgcattcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgattccttgcggcatcgttttgacacgcaaacattatgtggagcgtattgctcgcagtgttgaatatgtcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgcgtcgtaatccatgcgccattaccgttgtgttcccgaaacctccgcagtcagtgctgcacaagtggcaaatcgcagtagagggcgaccgcgcgcatattgtcttaatgccaagtaccaccctccagcatgtcgatgaattgatcgctgacattgcagccgccaataaagcggctgcagcaccgagcgatacgcagaaacccgccgccaagaaacgcccgacaccggctggtgcaccgcaacgtactacgtag

SEQ ID NO: 74 - protein, 406 aa, Artificial Sequence
  Variant of Leucine Decarboxylase from Planctomycetaceae bacterium
MGNLKFPDGALSPHDRRRLEDVYQYVREQCDTFLGYPCNMHFDYTPLLPFLAYPVNNVGDPFAASSYRVHTREIEREVLAWFAELMHIAPEEYWGYVTNGGSEGNLYGLFLARERFPTGVAYYSEDTHYSVYKNLRLLNMRHIMIKSQPNGEIDYGDLYETMRIHRDCPPIIFANIGTTMTEGIDNVRTIQDMFKKLAIHESHIHCDAALAGMTLPFMDDAPAFDFATGIDSLSISGHKFIGSPIPCGIVLTRKHYVERIARSVEYVGTLDTTISGSRNGITPLFLWYAVKQAGRDGFKRRVAACLDNARYTVEQFKRIGVEARRNPCAITVVFPKPPQSVLHKWQIAVEGDRAHIVLMPSTTLQHVDELIADIAAANKAAAAPSDTQKPAAKKRPTPAGAPQRTT

SEQ ID NO: 75 - DNA, 1221 bp, Artificial Sequence
  Variant of Leucine Decarboxylase from Planctomycetaceae bacterium
atgggtaatctgaaatttccagatggcgcgttgagcccgcatgaccgccgccgtctggaagatgtgtatcagtacgttcgtgagcaatgcgacaccttcatcgggtatccggtaaacatgcactttgattacacacctcttttaccgttcctggcctatcccgtcaacaacgtgggcgatccgtttgctgcatccagttatcgcgtgcatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcattcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgattccttgcggcatcgttttgacacgcaaacattatgtggagcgtattgctcgcagtatcgaatatgtcggtaccctggacactacgattaccggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgcgtcgtaatccatgcgccattaccgttgtgttcccgaaacctccgcagtcagtgctgcacaagtggcaaatcgcagtagagggcgaccgcgcgcatattgtcttaatgccaagtaccaccctccagcatgtcgatgaattgatcgctgacattgcagccgccaataaagcggctgcagcaccgagcgatacgcagaaacccgccgccaagaaacgcccgacaccggctggtgcaccgcaacgtactacgtag

SEQ ID NO: 76 - protein, 406 aa, Artificial Sequence
  Variant of Leucine Decarboxylase from Planctomycetaceae bacterium
MGNLKFPDGALSPHDRRRLEDVYQYVREQCDTFIGYPVNMHFDYTPLLPFLAYPVNNVGDPFAASSYRVHTREIEREVLAWFAELMHIAPEEYWGYVTNGGSEGNLYGLFLARERFPTGVAYYSEDSHYSVYKNLRLLNMRHIMIKSQPNGEIDYGDLYETMRIHRDCPPIIFANIGTTMTEGIDNVRTIQDMFKKLAIHESHIHCDAALAGMTLPFMDDAPAFDFATGIDSLSISGHKFIGSPIPCGIVLTRKHYVERIARSIEYVGTLDTTITGSRNGITPLFLWYAVKQAGRDGFKRRVAACLDNARYTVEQFKRIGVEARRNPCAITVVFPKPPQSVLHKWQIAVEGDRAHIVLMPSTTLQHVDELIADIAAANKAAAAPSDTQKPAAKKRPTPAGAPQRTT

SEQ ID NO: 77 - DNA, 1221 bp, Artificial Sequence
  Variant of Leucine Decarboxylase from Planctomycetaceae bacterium
atgggtaatctgaaatttccagatggcgcgttgagcccgcatgaccgccgccgtctggaagatgtgtatcagtacgttcgtgagcaatgcgacaccttcatcgggtatccggtaaacatgcactttgattacacacctcttttaccgttcctggcctatcccgtcaacaacgtgggcgatccgtttgctgcatccagttatcgcgtgcatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcattcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgattccttgcggcatcgttttgacacgcaaacattatgtggagcgtattgctcgcagtatcgaatatgtcggtaccctggacactacgattacgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgcgtcgtaatccatgcgccattaccgttgtgttcccgaaacctccgcagtcagtgctgcacaagtggcaaatcgcaaccgagggcgaccgcgcgcatattgtcttaatgccaagtaccaccctccagcatgtcgatgaattgatcgctgacattgcagccgccaataaagcggctgcagcaccgagcgatacgcagaaacccgccgccaagaaacgcccgacaccggctggtgcaccgcaacgtactacgtag

SEQ ID NO: 78 - protein, 406 aa, Artificial Sequence
  Variant of Leucine Decarboxylase from Planctomycetaceae bacterium
MGNLKFPDGALSPHDRRRLEDVYQYVREQCDTFIGYPVNMHFDYTPLLPFLAYPVNNVGDPFAASSYRVHTREIEREVLAWFAELMHIAPEEYWGYVTNGGSEGNLYGLFLARERFPTGVAYYSEDSHYSVYKNLRLLNMRHIMIKSQPNGEIDYGDLYETMRIHRDCPPIIFANIGTTMTEGIDNVRTIQDMFKKLAIHESHIHCDAALAGMTLPFMDDAPAFDFATGIDSLSISGHKFIGSPIPCGIVLTRKHYVERIARSIEYVGTLDTTITGSRNGITPLFLWYAVKQAGRDGFKRRVAACLDNARYTVEQFKRIGVEARRNPCAITVVFPKPPQSVLHKWQIATEGDRAHIVLMPSTTLQHVDELIADIAAANKAAAAPSDTQKPAAKKRPTPAGAPQRTT

SEQ ID NO: 79 - DNA, 1221 bp, Artificial Sequence
  Variant of Leucine Decarboxylase from Planctomycetaceae bacterium
atgggtaatctgaaatttccagatggcgcgttgagcccgcatgaccgccgccgtctggaagatgtgtatcagtacgttcgtgagcaatgcgacaccttcatcgggtatccgtgcaacatgcactttgattacacacctcttttaccgttcctggcctatcccgtcaacaacgtgggcgatccgtttgctgcatccagttatcgcgtgcatacccgtgaaatcgaacgcgaggttctggcgtggttcgccgaactcatgcacattgcaccagaagaatactggggttatgtgactaatggaggaaccgagggcaacctgtacggtttgtttttagcgcgtgaacgctttcctacgggcgtcgcctactattcggaagacacgcattatagcgtgtataagaatctgcgtctgctgaacatgcgtcacatcatgatcaaatcacagccgaatggtgagattgattacggcgatctctacgaaactatgcgcattcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgattccttgcggcatcgttttgacacgcaaacattatgtggagcgtattgctcgcagtgttgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgcgtcgtaatccatgcgccattaccgttgtgttcccgaaacctccgcagtcagtgctgcacaagtggcaaatcgcagtagagggcgaccgcgcgcatattatcttaatgccaagtaccaccctccagcatgtcgatgaattgatcgctgacattgcagccgccaataaagcggctgcagcaccgagcgatacgcagaaacccgccgccaagaaacgcccgacaccggctggtgcaccgcaacgtactacgtag

SEQ ID NO: 80 - protein, 406 aa, Artificial Sequence
  Variant of Leucine Decarboxylase from Planctomycetaceae bacterium
MGNLKFPDGALSPHDRRRLEDVYQYVREQCDTFIGYPCNMHFDYTPLLPFLAYPVNNVGDPFAASSYRVHTREIEREVLAWFAELMHIAPEEYWGYVTNGGTEGNLYGLFLARERFPTGVAYYSEDTHYSVYKNLRLLNMRHIMIKSQPNGEIDYGDLYETMRIHRDCPPIIFANIGTTMTEGIDNVRTIQDMFKKLAIHESHIHCDAALAGMTLPFMDDAPAFDFATGIDSLSISGHKFIGSPIPCGIVLTRKHYVERIARSVEYIGTLDTTISGSRNGITPLFLWYAVKQAGRDGFKRRVAACLDNARYTVEQFKRIGVEARRNPCAITVVFPKPPQSVLHKWQIAVEGDRAHIILMPSTTLQHVDELIADIAAANKAAAAPSDTQKPAAKKRPTPAGAPQRTT

SEQ ID NO: 81 - DNA, 1221 bp, Artificial Sequence
  Variant of Leucine Decarboxylase from Planctomycetaceae bacterium
atgggtaatctgaaatttccagatggcgcgttgagcccgcatgaccgccgccgtctggaagatgtgtatcagtacgttcgtgagcaatgcgacaccttcatcgggtatccgtgcaacatgcactttgattacacacctcttttaccgttcctggcctatcccgtcaacaacgtgggcgatccgtttgctgcatccagttatcgcgtgcatacccgtgaaatcgaacgcgaggttctggcgtggttcgccgaactcatgcacattgcaccagaagaatactggggttatgtgactaatggaggaacggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcattcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgattccttgcggcatcgttttgacacgcaaacattatgtggagcgtattgctcgcagtatcgaatatgtcggtaccctggacactacgattaccggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgcgtcgtaatccatgcgccattaccgttgtgttcccgaaacctccgcagtcagtgctgcacaagtggcaaatcgcagttaatggcgaccgcgcgcatattgtcttaatgccaagtaccaccctccagcatgtcgatgaattgatcgctgacattgcagccgccaataaagcggctgcagcaccgagcgatacgcagaaacccgccgccaagaaacgcccgacaccggctggtgcaccgcaacgtactacgtag

SEQ ID NO: 82 - protein, 406 aa, Artificial Sequence
  Variant of Leucine Decarboxylase from Planctomycetaceae bacterium
MGNLKFPDGALSPHDRRRLEDVYQYVREQCDTFIGYPCNMHFDYTPLLPFLAYPVNNVGDPFAASSYRVHTREIEREVLAWFAELMHIAPEEYWGYVTNGGTEGNLYGLFLARERFPTGVAYYSEDSHYSVYKNLRLLNMRHIMIKSQPNGEIDYGDLYETMRIHRDCPPIIFANIGTTMTEGIDNVRTIQDMFKKLAIHESHIHCDAALAGMTLPFMDDAPAFDFATGIDSLSISGHKFIGSPIPCGIVLTRKHYVERIARSIEYVGTLDTTITGSRNGITPLFLWYAVKQAGRDGFKRRVAACLDNARYTVEQFKRIGVEARRNPCAITVVFPKPPQSVLHKWQIAVNGDRAHIVLMPSTTLQHVDELIADIAAANKAAAAPSDTQKPAAKKRPTPAGAPQRTT

SEQ ID NO: 83 - DNA, 1221 bp, Artificial Sequence
  Variant of Leucine Decarboxylase from Planctomycetaceae bacterium
atgggtaatctgaaatttccagatggcgcgttgagcccgcatgaccgccgccgtctggaagatgtgtatcagtacgttcgtgagcaatgcgacaccttcatcgggtatccgtgcaacatgcactttgattacacacctcttttaccgttcctggcctatcccgtcaacaacgtgggcgatccgtttgctgcatccagttatcgcgtgcatacccgtgaaatcgaacgcgaggttctggcgtggttcgccgaactcatgcacattgcaccagaagaatactggggttatgtgactaatggaggaaccgagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcattcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaacattatgtggagcgtattgctcgcagtgttgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgcgtcgtaatccatgcgccattaccgttgtgttcccgaaacctccgcagtcagtgctgcacaagtggcaaatcgcagtagagggcgaccgcgcgcatattatcttaatgccaagtaccaccctccagcatgtcgatgaattgatcgctgacattgcagccgccaataaagcggctgcagcaccgagcgatacgcagaaacccgccgccaagaaacgcccgacaccggctggtgcaccgcaacgtactacgtag

SEQ ID NO: 84 - protein, 406 aa, Artificial Sequence
  Variant of Leucine Decarboxylase from Planctomycetaceae bacterium
MGNLKFPDGALSPHDRRRLEDVYQYVREQCDTFIGYPCNMHFDYTPLLPFLAYPVNNVGDPFAASSYRVHTREIEREVLAWFAELMHIAPEEYWGYVTNGGTEGNLYGLFLARERFPTGVAYYSEDSHYSVYKNLRLLNMRHIMIKSQPNGEIDYGDLYETMRIHRDCPPIIFANIGTTMTEGIDNVRTIQDMFKKLAIHESHIHCDAALAGMTLPFMDDAPAFDFATGIDSLSISGHKFIGSPMPCGIVLTRKHYVERIARSVEYIGTLDTTISGSRNGITPLFLWYAVKQAGRDGFKRRVAACLDNARYTVEQFKRIGVEARRNPCAITVVFPKPPQSVLHKWQIAVEGDRAHIILMPSTTLQHVDELIADIAAANKAAAAPSDTQKPAAKKRPTPAGAPQRTT

SEQ ID NO: 85 - DNA, 1221 bp, Artificial Sequence
  Variant of Leucine Decarboxylase from Planctomycetaceae bacterium
atgggtaatctgaaatttccagatggcgcgttgagcccgcatgaccgccgccgtctggaagatgtgtatcagtacgttcgtgagcaatgcgacaccttcatcgggtatccggtaaacatgcactttgattacacacctcttttaccgttcctggcctatcccgtcaacaacgtgggcgatccgtttgctgcatccagttatcgcgtgcatacccgtgaaatcgaacgcgaggttctggcgtggttcgccgaactcatgcacattgcaccagaagaatactggggttatgtgactaatggaggaaccgagggcaacctgtacggtttgtttttagcgcgtgaacgctttcctacgggcgtcgcctactattcggaagacacgcattatagcgtgtataagaatctgcgtctgctgaacatgcgtcacatcatgatcaaatcacagccgaatggtgagattgattacggcgatctctacgaaactatgcgcattcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgattccttgcggcatcgttttgacacgcaaacattatgtggagcgtattgctcgcagtgttgaatatgtcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgcgtcgtaatccatgcgccattaccgttgtgttcccgaaacctccgcagtcagtgctgcacaagtggcaaatcgcagttaacggcgaccgcgcgcatattgtcttaatgccaagtaccaccctccagcatgtcgatgaattgatcgctgacattgcagccgccaataaagcggctgcagcaccgagcgatacgcagaaacccgccgccaagaaacgcccgacaccggctggtgcaccgcaacgtactacgtag

SEQ ID NO: 86 - protein, 406 aa, Artificial Sequence
  Variant of Leucine Decarboxylase from Planctomycetaceae bacterium
MGNLKFPDGALSPHDRRRLEDVYQYVREQCDTFIGYPVNMHFDYTPLLPFLAYPVNNVGDPFAASSYRVHTREIEREVLAWFAELMHIAPEEYWGYVTNGGTEGNLYGLFLARERFPTGVAYYSEDTHYSVYKNLRLLNMRHIMIKSQPNGEIDYGDLYETMRIHRDCPPIIFANIGTTMTEGIDNVRTIQDMFKKLAIHESHIHCDAALAGMTLPFMDDAPAFDFATGIDSLSISGHKFIGSPIPCGIVLTRKHYVERIARSVEYVGTLDTTISGSRNGITPLFLWYAVKQAGRDGFKRRVAACLDNARYTVEQFKRIGVEARRNPCAITVVFPKPPQSVLHKWQIAVNGDRAHIVLMPSTTLQHVDELIADIAAANKAAAAPSDTQKPAAKKRPTPAGAPQRTT

SEQ ID NO: 87 - DNA, 1221 bp, Artificial Sequence
  Variant of Leucine Decarboxylase from Planctomycetaceae bacterium
atgggtaatctgaaatttccagatggcgcgttgagcccgcatgaccgccgccgtctggaagatgtgtatcagtacgttcgtgagcaatgcgacaccttcatcgggtatccgtgcaacatgcactttgattacacacctcttttaccgttcctggcctatcccgtcaacaacgtgggcgatccgtttgctgcatccagttatcgcgtgcatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagacacgcattatagcgtgtataagaatctgcgtctgctgaacatgcgtcacatcatgatcaaatcacagccgaatggtgagattgattacggcgatctctacgaaactatgcgcattcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgattccttgcggcatcgttttgacacgcaaacattatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgcgtcgtaatccatgcgccattaccgttgtgttcccgaaacctccgcagtcagtgctgcacaagtggcaaatcgcagtaaatggcgaccgcgcgcatattgtcttaatgccaagtaccaccctccagcatgtcgatgaattgatcgctgacattgcagccgccaataaagcggctgcagcaccgagcgatacgcagaaacccgccgccaagaaacgcccgacaccggctggtgcaccgcaacgtactacgtag

SEQ ID NO: 88 - protein, 406 aa, Artificial Sequence
  Variant of Leucine Decarboxylase from Planctomycetaceae bacterium
MGNLKFPDGALSPHDRRRLEDVYQYVREQCDTFIGYPCNMHFDYTPLLPFLAYPVNNVGDPFAASSYRVHTREIEREVLAWFAELMHIAPEEYWGYVTNGGSEGNLYGLFLARERFPTGVAYYSEDTHYSVYKNLRLLNMRHIMIKSQPNGEIDYGDLYETMRIHRDCPPIIFANIGTTMTEGIDNVRTIQDMFKKLAIHESHIHCDAALAGMTLPFMDDAPAFDFATGIDSLSISGHKFIGSPIPCGIVLTRKHYVERIARSIEYIGTLDTTISGSRNGITPLFLWYAVKQAGRDGFKRRVAACLDNARYTVEQFKRIGVEARRNPCAITVVFPKPPQSVLHKWQIAVNGDRAHIVLMPSTTLQHVDELIADIAAANKAAAAPSDTQKPAAKKRPTPAGAPQRTT

SEQ ID NO: 89 - DNA, 1221 bp, Artificial Sequence
  Variant of Leucine Decarboxylase from Planctomycetaceae bacterium
atgggtaatctgaaatttccagatggcgcgttgagcccgcatgaccgccgccgtctggaagatgtgtatcagtacgttcgtgagcaatgcgacaccttcattgggtatccgtgtacgatgcactttgattacacacctcttttaccgttcctggcctatcccgtcaacaacgtaggcgatccgtttgctgcatccagttatcgcgtgcatacccgtgaaatcgaacgcgaggttctggcgtggttcgccgaactcatgcacattgcaccagaagaatactggggttatgtgactaatggaggaaccgagggcaacctgtacggtttgtttttagcgcgtgaacgctttcctacgggcgtcgcctactattcggaagacacccattatagcgtgtataagaatctgcgtctgctgaacatgcgtcacatcatgatcaaatcacagccgaatggtgagattgattacggcgatctctacgaaactatgcgcattcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgattccttgcggcatcgttttgacacgcaaacattatgtggagcgtattgctcgcagtatcgaatatgtcggtaccctggacactacgattaccggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgcgtcgtaatccatgcgccattaccgttgtgttcccgaaacctccgcagtcagtgctgcacaagtggcaaatcgcagttaacggcgaccgcgcgcatattattttaatgccaagtaccaccctccagcatgtcgatgaattgatcgctgacattgcagccgccaataaagcggctgcagcaccgagcgatacgcagaaacccgccgccaagaaagatccgacaccggctggtgcaccgcaacgtactacgtag

SEQ ID NO: 90 - protein, 406 aa, Artificial Sequence
  Variant of Leucine Decarboxylase from Planctomycetaceae bacterium
MGNLKFPDGALSPHDRRRLEDVYQYVREQCDTFIGYPCTMHFDYTPLLPFLAYPVNNVGDPFAASSYRVHTREIEREVLAWFAELMHIAPEEYWGYVTNGGTEGNLYGLFLARERFPTGVAYYSEDTHYSVYKNLRLLNMRHIMIKSQPNGEIDYGDLYETMRIHRDCPPIIFANIGTTMTEGIDNVRTIQDMFKKLAIHESHIHCDAALAGMTLPFMDDAPAFDFATGIDSLSISGHKFIGSPIPCGIVLTRKHYVERIARSIEYVGTLDTTITGSRNGITPLFLWYAVKQAGRDGFKRRVAACLDNARYTVEQFKRIGVEARRNPCAITVVFPKPPQSVLHKWQIAVNGDRAHIILMPSTTLQHVDELIADIAAANKAAAAPSDTQKPAAKKDPTPAGAPQRTT

SEQ ID NO: 91 - DNA, 1221 bp, Artificial Sequence
  Variant of Leucine Decarboxylase from Planctomycetaceae bacterium
atgggtaatctgaaatttccagatggcgcgttgagcccgcatgaccgccgccgtctggaagatgtgtatcagtacgttcgtgagcaatgcgacaccttcattgggtatccgtgtacgatgcactttgattacacacctcttttaccgttcctggcctatcccgtcaacaacgtaggcgatccgtttgctgcatccagttatcgcgtgcatacccgtgaaatcgaacgcgaggttctggcgtggttcgccgaactcatgcacattgcaccagaagaatactggggttatgtgactaatggaggaaccgagggcaacctgtacggtttgtttttagcgcgtgaacgctttcctacgggcgtcgcctactattcggaagacacccattatagcgtgtataagaatctgcgtctgctgaacatgcgtcacatcatgatcaaatcacagccgaatggtgagattgattacggcgatctctacgaaactatgcgcattcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgattccttgcggcatcgttttgacacgcaaacattatgtggagcgtattgctcgcagtatcgaatatgtcggtaccctggacactacgattaccggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgcgtcgtaatccatgcgccattaccgttgtgttcccgaaacctccgcagtcagtgctgcacaagtggcaaatcgcagttaacggcgaccgcgcgcatattattttaatgccaagtaccaccctccagcatgtcgatgaattgatcgctgacattgcagccgccaataaagcggctgcagcaccgagcgatacgcagaaacccgccgccaagaaacgcccggcgccggctggtgcaccgcaacgtactacgtag

SEQ ID NO: 92 - protein, 406 aa, Artificial Sequence
  Variant of Leucine Decarboxylase from Planctomycetaceae bacterium
MGNLKFPDGALSPHDRRRLEDVYQYVREQCDTFIGYPCTMHFDYTPLLPFLAYPVNNVGDPFAASSYRVHTREIEREVLAWFAELMHIAPEEYWGYVTNGGTEGNLYGLFLARERFPTGVAYYSEDTHYSVYKNLRLLNMRHIMIKSQPNGEIDYGDLYETMRIHRDCPPIIFANIGTTMTEGIDNVRTIQDMFKKLAIHESHIHCDAALAGMTLPFMDDAPAFDFATGIDSLSISGHKFIGSPIPCGIVLTRKHYVERIARSIEYVGTLDTTITGSRNGITPLFLWYAVKQAGRDGFKRRVAACLDNARYTVEQFKRIGVEARRNPCAITVVFPKPPQSVLHKWQIAVNGDRAHIILMPSTTLQHVDELIADIAAANKAAAAPSDTQKPAAKKRPAPAGAPQRTT

SEQ ID NO: 93 - DNA, 1221 bp, Artificial Sequence
  Variant of Leucine Decarboxylase from Planctomycetaceae bacterium
atgggtaatctgaaatttccagatggcgcgttgagcccgcatgaccgccgccgtctggaagatgtgtatcagtacgttcgtgagcaatgcgacaccttcattgggtatccgtgttctatgcactttgattacacacctcttttaccgttcctggcctatcccgtcaacaacgtaggcgatccgtttgctgcatccagttatcgcgtgcatacccgtgaaatcgaacgcgaggttctggcgtggttcgccgaactcatgcacattgcaccagaagaatactggggttatgtgactaatggaggaaccgagggcaacctgtacggtttgtttttagcgcgtgaacgctttcctacgggcgtcgcctactattcggaagacacccattatagcgtgtataagaatctgcgtctgctgaacatgcgtcacatcatgatcaaatcacagccgaatggtgagattgattacggcgatctctacgaaactatgcgcattcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgattccttgcggcatcgttttgacacgcaaacattatgtggagcgtattgctcgcagtatcgaatatgtcggtaccctggacactacgattaccggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgcgtcgtaatccatgcgccattaccgttgtgttcccgaaacctccgcagtcagtgctgcacaagtggcaaatcgcagttaacggcgaccgcgcgcatattattttaatgccaagtaccaccctccagcatgtcgatgaattgatcgctgacattgcagccgccaataaagcggctgcagcaccgagcgatacgcagaaacccgccgccaagaaacgcccgacaccggctggtgcaccgcaacgtactacgtag

SEQ ID NO: 94 - protein, 406 aa, Artificial Sequence
  Variant of Leucine Decarboxylase from Planctomycetaceae bacterium
MGNLKFPDGALSPHDRRRLEDVYQYVREQCDTFIGYPCSMHFDYTPLLPFLAYPVNNVGDPFAASSYRVHTREIEREVLAWFAELMHIAPEEYWGYVTNGGTEGNLYGLFLARERFPTGVAYYSEDTHYSVYKNLRLLNMRHIMIKSQPNGEIDYGDLYETMRIHRDCPPIIFANIGTTMTEGIDNVRTIQDMFKKLAIHESHIHCDAALAGMTLPFMDDAPAFDFATGIDSLSISGHKFIGSPIPCGIVLTRKHYVERIARSIEYVGTLDTTITGSRNGITPLFLWYAVKQAGRDGFKRRVAACLDNARYTVEQFKRIGVEARRNPCAITVVFPKPPQSVLHKWQIAVNGDRAHIILMPSTTLQHVDELIADIAAANKAAAAPSDTQKPAAKKRPTPAGAPQRTT

SEQ ID NO: 95 - DNA, 1221 bp, Artificial Sequence
  Variant of Leucine Decarboxylase from Planctomycetaceae bacterium
atgggtaatctgaaatttccagatggcgcgttgagcccgcatgaccgccgccgtctggaagatgtgtatcagtacgttcgtgagcaatgcgacaccttcattgggtatccgtgtacgatgcactttgattacacacctcttttaccgttcctggcctatcccgtcaacaacgtaggcgatccgtttgctgcatccagttatcgcgtgcatacccgtgaaatcgaacgcgaggttctggcgtggttcgccgaactcatgcacattgcaccagaagaatactggggttatgtgactaatggaggaaccgagggcaacctgtacggtttgtttttagcgcgtgaacgctttcctacgggcgtcgcctactattcggaagacacccattatagcgtgtataagaatctgcgtctgctgaacatgcgtcacatcatgatcaaatcacagccgaatggtgagattgattacggcgatctctacgaaactatgcgcattcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgattccttgcggcatcgttttgacacgcaaacattatgtggagcgtattgctcgcagtatcgaatatgtcggtaccctggacactacgattaccggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgcgtcgtaatccatgcgccattaccgttgtgttcccgaaacctccgcagtcagtgctgcacaagtggcaaatcgcagttaacggcgaccgcgcgcatattattttaatgccaagtaccaccctccagcatgtcgatgaattgatcgctgacattgcagccgccaataaagcggctgcagcaccgagcgatacgcagaaacccgccgccaagaaacgcccgacataggctggtgcaccgcaacgtactacgtag

SEQ ID NO: 96 - protein, 397 aa, Artificial Sequence
  Variant of Leucine Decarboxylase from Planctomycetaceae bacterium
MGNLKFPDGALSPHDRRRLEDVYQYVREQCDTFIGYPCTMHFDYTPLLPFLAYPVNNVGDPFAASSYRVHTREIEREVLAWFAELMHIAPEEYWGYVTNGGTEGNLYGLFLARERFPTGVAYYSEDTHYSVYKNLRLLNMRHIMIKSQPNGEIDYGDLYETMRIHRDCPPIIFANIGTTMTEGIDNVRTIQDMFKKLAIHESHIHCDAALAGMTLPFMDDAPAFDFATGIDSLSISGHKFIGSPIPCGIVLTRKHYVERIARSIEYVGTLDTTITGSRNGITPLFLWYAVKQAGRDGFKRRVAACLDNARYTVEQFKRIGVEARRNPCAITVVFPKPPQSVLHKWQIAVNGDRAHIILMPSTTLQHVDELIADIAAANKAAAAPSDTQKPAAKKRPT

SEQ ID NO: 97 - DNA, 1221 bp, Artificial Sequence
  Variant of Leucine Decarboxylase from Planctomycetaceae bacterium
atgggtaatctgaaatttccagatggcgcgttgagcccgcatgaccgccgccgtctggaagatgtgtatcagtacgttcgtgagcaatgcgacaccttcattgggtatccgtgtacgatgcactttgattacacacctcttttaccgttcctggcctatcccgtcaacaacgtaggcgatccgtttgctgcatccagttatcgcgtgcatacccgtgaaatcgaacgcgaggttctggcgtggttcgccgaactcatgcacattgcaccagaagaatactggggttatgtgactaatggaggaaccgagggcaacctgtacggtttgtttttagcgcgtgaacgctttcctacgggcgtcgcctactattcggaagacacccattatagcgtgtataagaatctgcgtctgctgaacatgcgtcacatcatgatcaaatcacagccgaatggtgagattgattacggcgatctctacgaaactatgcgcattcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgattccttgcggcatcgttttgacacgcaaacattatgtggagcgtattgctcgcagtatcgaatatgtcggtaccctggacactacgattaccggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgcgtcgtaatccatgcgccattaccgttgtgttcccgaaacctccgcagtcagtgctgcacaagtggcaaatcgcagttaacggcgaccgcgcgcatattattttaatgccaagtaccaccctccagcatgtcgatgaattgatcgctgacattgcagccgccaataaagcggctgcagcaccgagcgatacgcaggggcccgccgccaagaaacgcccgacaccggctggtgcaccgcaacgtactacgtag

SEQ ID NO: 98 - protein, 406 aa, Artificial Sequence
  Variant of Leucine Decarboxylase from Planctomycetaceae bacterium
MGNLKFPDGALSPHDRRRLEDVYQYVREQCDTFIGYPCTMHFDYTPLLPFLAYPVNNVGDPFAASSYRVHTREIEREVLAWFAELMHIAPEEYWGYVTNGGTEGNLYGLFLARERFPTGVAYYSEDTHYSVYKNLRLLNMRHIMIKSQPNGEIDYGDLYETMRIHRDCPPIIFANIGTTMTEGIDNVRTIQDMFKKLAIHESHIHCDAALAGMTLPFMDDAPAFDFATGIDSLSISGHKFIGSPIPCGIVLTRKHYVERIARSIEYVGTLDTTITGSRNGITPLFLWYAVKQAGRDGFKRRVAACLDNARYTVEQFKRIGVEARRNPCAITVVFPKPPQSVLHKWQIAVNGDRAHIILMPSTTLQHVDELIADIAAANKAAAAPSDTQGPAAKKRPTPAGAPQRTT

SEQ ID NO: 99 - DNA, 1221 bp, Artificial Sequence
  Variant of Leucine Decarboxylase from Planctomycetaceae bacterium
atgggtaatctgaaatttccagatggcgcgttgagcccgcatgaccgccgccgtctggaagatgtgtatcagtacgttcgtgagcaatgcgacaccttcattgggtatccgtgtacgatgcactttgattacacacctcttttaccgttcctggcctatcccgtcaacaacgtaggcgatccgtttgctgcatccagttatcgcgtgcatacccgtgaaatcgaacgcgaggttctggcgtggttcgccgaactcatgcacattgcaccagaagaatactggggttatgtgactaatggaggaaccgagggcaacctgtacggtttgtttttagcgcgtgaacgctttcctacgggcgtcgcctactattcggaagacacccattatagcgtgtataagaatctgcgtctgctgaacatgcgtcacatcatgatcaaatcacagccgaatggtgagattgattacggcgatctctacgaaactatgcgcattcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgattccttgcggcatcgttttgacacgcaaacattatgtggagcgtattgctcgcagtatcgaatatgtcggtaccctggacactacgattaccggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgcgtcgtaatccatgcgccattaccgttgtgttcccgaaacctccgcagtcagtgctgcacaagtggcaaatcgcagttaacggcgaccgcgcgcatattattttaatgccaagtaccaccctccagcatgtcgatgaattgatcgctgacattgcagccgccaataaagcggctgcagcaccgagcgatacgcagcagcccgccgccaagaaacgcccgacaccggctggtgcaccgcaacgtactacgtag

SEQ ID NO: 100 - protein, 406 aa, Artificial Sequence
  Variant of Leucine Decarboxylase from Planctomycetaceae bacterium
MGNLKFPDGALSPHDRRRLEDVYQYVREQCDTFIGYPCTMHFDYTPLLPFLAYPVNNVGDPFAASSYRVHTREIEREVLAWFAELMHIAPEEYWGYVTNGGTEGNLYGLFLARERFPTGVAYYSEDTHYSVYKNLRLLNMRHIMIKSQPNGEIDYGDLYETMRIHRDCPPIIFANIGTTMTEGIDNVRTIQDMFKKLAIHESHIHCDAALAGMTLPFMDDAPAFDFATGIDSLSISGHKFIGSPIPCGIVLTRKHYVERIARSIEYVGTLDTTITGSRNGITPLFLWYAVKQAGRDGFKRRVAACLDNARYTVEQFKRIGVEARRNPCAITVVFPKPPQSVLHKWQIAVNGDRAHIILMPSTTLQHVDELIADIAAANKAAAAPSDTQQPAAKKRPTPAGAPQRTT

SEQ ID NO: 101 - DNA, 1221 bp, Artificial Sequence
  Variant of Leucine Decarboxylase from Planctomycetaceae bacterium
atgggtaatctgaaatttccagatggcgcgttgagcccgcatgaccgccgccgtctggaagatgtgtatcagtacgttcgtgagcaatgcgacaccttcattgggtatccgtgtacgatgcactttgattacacacctctttttccgttcctggcctatcccgtcaacaacgtaggcgatccgtttgctgcatccagttatcgcgtgcatacccgtgaaatcgaacgcgaggttctggcgtggttcgccgaactcatgcacattgcaccagaagaatactggggttatgtgactaatggaggaaccgagggcaacctgtacggtttgtttttagcgcgtgaacgctttcctacgggcgtcgcctactattcggaagacacccattatagcgtgtataagaatctgcgtctgctgaacatgcgtcacatcatgatcaaatcacagccgaatggtgagattgattacggcgatctctacgaaactatgcgcattcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgattccttgcggcatcgttttgacacgcaaacattatgtggagcgtattgctcgcagtatcgaatatgtcggtaccctggacactacgattaccggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgcgtcgtaatccatgcgccattaccgttgtgttcccgaaacctccgcagtcagtgctgcacaagtggcaaatcgcagttaacggcgaccgcgcgcatattattttaatgccaagtaccaccctccagcatgtcgatgaattgatcgctgacattgcagccgccaataaagcggctgcagcaccgagcgatacgcagaaacccgccgccaagaaacgcccgacaccggctggtgcaccgcaacgtactacgtag

SEQ ID NO: 102 - protein, 406 aa, Artificial Sequence
  Variant of Leucine Decarboxylase from Planctomycetaceae bacterium
MGNLKFPDGALSPHDRRRLEDVYQYVREQCDTFIGYPCTMHFDYTPLFPFLAYPVNNVGDPFAASSYRVHTREIEREVLAWFAELMHIAPEEYWGYVTNGGTEGNLYGLFLARERFPTGVAYYSEDTHYSVYKNLRLLNMRHIMIKSQPNGEIDYGDLYETMRIHRDCPPIIFANIGTTMTEGIDNVRTIQDMFKKLAIHESHIHCDAALAGMTLPFMDDAPAFDFATGIDSLSISGHKFIGSPIPCGIVLTRKHYVERIARSIEYVGTLDTTITGSRNGITPLFLWYAVKQAGRDGFKRRVAACLDNARYTVEQFKRIGVEARRNPCAITVVFPKPPQSVLHKWQIAVNGDRAHIILMPSTTLQHVDELIADIAAANKAAAAPSDTQKPAAKKRPTPAGAPQRTT

SEQ ID NO: 103 - DNA, 1221 bp, Artificial Sequence
  Variant of Leucine Decarboxylase from Planctomycetaceae bacterium
atgggtaatctgaaatttccagatggcgcgttgagcccgcatgaccgccgccgtctggaagatgtgtatcagtacgttcgtgagcaatgcgacaccttcattgggtatccgtgtacgatgcactttgattacacacctcttttaccgttcctggcctatcccgtcaacaacgtaggcgatccgtttgctgcatccagttatcgcgtgcatacccgtgaaatcgaacgcgaggttctggcgtggttcgccgaactcatgcacattgcaccagaagaatactggggttatgtgactaatggaggaaccgagggcaacctgtacggtttgtttttagcgcgtgaacgctttcctacgggcgtcgcctactattcggaagacacccattatagcgtgtataagaatctgcgtctgctgaacatgcgtcacatcatgatcaaatcacagccgaatggtgagattgattacggcgatctctacgaaactatgcgcattcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgattccttgcggcatcgttttgacacgcaaacattatgtggagcgtattgctcgcagtatcgaatatgtcggtaccctggacactacgattaccggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgcgtcgtaatccatgcgccattaccgttgtgttcccgaaacctccgcagtcagtgctgcacaagtggcaaatcgcagttaacggcgaccgcgcgcatattattttaatgccaagtaccaccctccagcatgtcgatgaattgatcgctgacattgcagccgccaataaagcggctgcagcaccgagcgatacgcagaaacccgccgccaagaaacgcccgacaccggctggtgcaccgcaacgtcttacgtag

SEQ ID NO: 104 - protein, 406 aa, Artificial Sequence
  Variant of Leucine Decarboxylase from Planctomycetaceae bacterium
MGNLKFPDGALSPHDRRRLEDVYQYVREQCDTFIGYPCTMHFDYTPLLPFLAYPVNNVGDPFAASSYRVHTREIEREVLAWFAELMHIAPEEYWGYVTNGGTEGNLYGLFLARERFPTGVAYYSEDTHYSVYKNLRLLNMRHIMIKSQPNGEIDYGDLYETMRIHRDCPPIIFANIGTTMTEGIDNVRTIQDMFKKLAIHESHIHCDAALAGMTLPFMDDAPAFDFATGIDSLSISGHKFIGSPIPCGIVLTRKHYVERIARSIEYVGTLDTTITGSRNGITPLFLWYAVKQAGRDGFKRRVAACLDNARYTVEQFKRIGVEARRNPCAITVVFPKPPQSVLHKWQIAVNGDRAHIILMPSTTLQHVDELIADIAAANKAAAAPSDTQKPAAKKRPTPAGAPQRLT

SEQ ID NO: 105 - DNA, 1221 bp, Artificial Sequence
  Variant of Leucine Decarboxylase from Planctomycetaceae bacterium
atgggtaatctgaaatttccagatggcgcgttgagcccgcatgaccgccgccgtctggaagatgtgtatcagtacgttcgtgagcaatgcgacaccttcattgggtatccgtgtacgatgcactttgattacacacctcttttaccgttcctggcctatcccgtcaacaacgtaggcgatccgtttgctgcatccagttatcgcgtgcatacccgtgaaatcgaacgcgaggttctggcgtggttcgccgaactcatgcacattgcaccagaagaatactggggttatgtgactaatggaggaaccgagggcaacctgtacggtttgtttttagcgcgtgaacgctttcctacgggcgtcgcctactattcggaagacacccattatagcgtgtataagaatctgcgtctgctgaacatgcgtcacatcatgatcaaatcacagccgaatggtgagattgattacggcgatctctacgaaactatgcgcattcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgattccttgcggcatcgttttgacacgcaaacattatgtggagcgtattgctcgcagtatcgaatatgtcggtaccctggacactacgattaccggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgcgtcgtaatccatgcgccattaccgttgtgttcccgaaacctccgcagtcagtgctgcacaagtggcaaatcgcagttaacggcgaccgcgcgcatattattttaatgccaagtaccaccctccagcatgtcgatgaattgatcgctgacattgcagccgccaataaagcggctgcagcaccgagcgatacgcagaaaccctaggccaagaaacgcccgacaccggctggtgcaccgcaacgtactacgtag

SEQ ID NO: 106 - protein, 390 aa, Artificial Sequence
  Variant of Leucine Decarboxylase from Planctomycetaceae bacterium
MGNLKFPDGALSPHDRRRLEDVYQYVREQCDTFIGYPCTMHFDYTPLLPFLAYPVNNVGDPFAASSYRVHTREIEREVLAWFAELMHIAPEEYWGYVTNGGTEGNLYGLFLARERFPTGVAYYSEDTHYSVYKNLRLLNMRHIMIKSQPNGEIDYGDLYETMRIHRDCPPIIFANIGTTMTEGIDNVRTIQDMFKKLAIHESHIHCDAALAGMTLPFMDDAPAFDFATGIDSLSISGHKFIGSPIPCGIVLTRKHYVERIARSIEYVGTLDTTITGSRNGITPLFLWYAVKQAGRDGFKRRVAACLDNARYTVEQFKRIGVEARRNPCAITVVFPKPPQSVLHKWQIAVNGDRAHIILMPSTTLQHVDELIADIAAANKAAAAPSDTQKP

SEQ ID NO: 107 - DNA, 1221 bp, Artificial Sequence
  Variant of Leucine Decarboxylase from Planctomycetaceae bacterium
atgggtaatctgaaatttccagatggcgcgttgagcccgcatgaccgccgccgtctggaagatgtgtatcagtacgttcgtgagcaatgcgacaccttcattgggtatccgtgtacgatgcactttgattacacacctcttttaccgttcctggcctatcccgtcaacaacgtaggcgatccgtttgctgcatccagttatcgcgtgcatacccgtgaaatcgaacgcgaggttctggcgtggttcgccgaactcatgcacattgcaccagaagaatactggggttatgtgactaatggaggaaccgagggcaacctgtacggtttgtttttagcgcgtgaacgctttcctacgggcgtcgcctactattcggaagacacccattatagcgtgtataagaatctgcgtctgctgaacatgcgtcacatcatgatcaaatcacagccgaatggtgagattgattacggcgatctctacgaaactatgcgcattcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgattccttgcggcatcgttttgacacgcaaacattatgtggagcgtattgctcgcagtatcgaatatgtcggtaccctggacactacgattaccggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgcgtcgtaatccatgcgccattaccgttgtgttcccgaaacctccgcagtcagtgctggagaagtggcaaatcgcagttaacggcgaccgcgcgcatattattttaatgccaagtaccaccctccagcatgtcgatgaattgatcgctgacattgcagccgccaataaagcggctgcagcaccgagcgatacgcagaaacccgccgccaagaaacgcccgacaccggctggtgcaccgcaacgtactacgtag

SEQ ID NO: 108 - protein, 406 aa, Artificial Sequence
  Variant of Leucine Decarboxylase from Planctomycetaceae bacterium
MGNLKFPDGALSPHDRRRLEDVYQYVREQCDTFIGYPCTMHFDYTPLLPFLAYPVNNVGDPFAASSYRVHTREIEREVLAWFAELMHIAPEEYWGYVTNGGTEGNLYGLFLARERFPTGVAYYSEDTHYSVYKNLRLLNMRHIMIKSQPNGEIDYGDLYETMRIHRDCPPIIFANIGTTMTEGIDNVRTIQDMFKKLAIHESHIHCDAALAGMTLPFMDDAPAFDFATGIDSLSISGHKFIGSPIPCGIVLTRKHYVERIARSIEYVGTLDTTITGSRNGITPLFLWYAVKQAGRDGFKRRVAACLDNARYTVEQFKRIGVEARRNPCAITVVFPKPPQSVLEKWQIAVNGDRAHIILMPSTTLQHVDELIADIAAANKAAAAPSDTQKPAAKKRPTPAGAPQRTT

SEQ ID NO: 109 - DNA, 1221 bp, Artificial Sequence
  Variant of Leucine Decarboxylase from Planctomycetaceae bacterium
atgggtaatctgaaatttccagatggcgcgttgagcccgcatgaccgccgccgtctggaagatgtgtatcagtacgttcgtgagcaatgcgacaccttcattgggtatccgtgtacgatgcactttgattacacacctcttttaccgttcctggcctatcccgtcaacaacgtaggcgatccgtttgctgcatccagttatcgcgtgcatacccgtgaaatcgaacgcgaggttctggcgtggttcgccgaactcatgcacattgcaccagaagaatactggggttatgtgactaatggaggaaccgagggcaacctgtacggtttgtttttagcgcgtgaacgctttcctacgggcgtcgcctactattcggaagacacccattatagcgtgtataagaatctgcgtctgctgaacatgcgtcacatcatgatcaaatcacagccgaatggtgagattgattacggcgatctctacgaaactatgcgcattcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgattccttgcggcatcgttttgacacgcaaacattatgtggagcgtattgctcgcagtatcgaatatgtcggtaccctggacactacgattaccggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgcgtcgtaatccatgcgccattaccgttgtgttcccgaaacctccgcagtcagtgctgcacaagtggcaaatcgcagttaacggcgaccgcgcgcatattattttaatgccaagtaccaccctccagcatgtcgatgaattgatcgctgacattgcagccgccaataaagcggctgcagcaccgagcgatacgcagaaacccgccgccacgaaacgcccgacaccggctggtgcaccgcaacgtactacgtag

SEQ ID NO: 110 - protein, 406 aa, Artificial Sequence
  Variant of Leucine Decarboxylase from Planctomycetaceae bacterium
MGNLKFPDGALSPHDRRRLEDVYQYVREQCDTFIGYPCTMHFDYTPLLPFLAYPVNNVGDPFAASSYRVHTREIEREVLAWFAELMHIAPEEYWGYVTNGGTEGNLYGLFLARERFPTGVAYYSEDTHYSVYKNLRLLNMRHIMIKSQPNGEIDYGDLYETMRIHRDCPPIIFANIGTTMTEGIDNVRTIQDMFKKLAIHESHIHCDAALAGMTLPFMDDAPAFDFATGIDSLSISGHKFIGSPIPCGIVLTRKHYVERIARSIEYVGTLDTTITGSRNGITPLFLWYAVKQAGRDGFKRRVAACLDNARYTVEQFKRIGVEARRNPCAITVVFPKPPQSVLHKWQIAVNGDRAHIILMPSTTLQHVDELIADIAAANKAAAAPSDTQKPAATKRPTPAGAPQRTT

SEQ ID NO: 111 - DNA, 1221 bp, Artificial Sequence
  Variant of Leucine Decarboxylase from Planctomycetaceae bacterium
atgggtaatctgaaatttccagatggcgcgttgagcccgcatgaccgccgccgtctggaagatgtgtatcagtacgttcgtgagcaatgcgacaccttcattgggtatccgtgtacgatgcactttgattacacacctcttttaccgttcctggcctatcccgtcaacaacgtaggcgatccgtttgctgcatccagttatcgcgtgcatacccgtgaaatcgaacgcgaggttctggcgtggttcgccgaactcatgcacattgcaccagaagaatactggggttatgtgactaatggaggaaccgagggcaacctgtacggtttgtttttagcgcgtgaacgctttcctacgggcgtcgcctactattcggaagacacccattatagcgtgtataagaatctgcgtctgctgaacatgcgtcacatcatgatcaaatcacagccgaatggtgagattgattacggcgatctctacgaaactatgcgcattcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgattccttgcggcatcgttttgacacgcaaacattatgtggagcgtattgctcgcagtatcgaatatgtcggtaccctggacactacgattaccggcagccgtaatggtattacaccgctgtttctttggtacgcggtgaaacaagctggacgcgatggcttcgctcgtcgtgttgcggcatgtctggataacgcccgctatacggtcgagcagtttaaacgcatcggtgtagaagcgcgtcgtaatccatgcgccattaccgttgtgttcccgaaacctccgcagtcagtgctgcacaagtggcaaatcgcagttaacggcgaccgcgcgcatattattttaatgccaagtaccaccctccagcatgtcgatgaattgatcgctgacattgcagccgccaataaagcggctgcagcaccgagcgatacgcagaaacccgccgccaagaaacgcccgacaccggctggtgcaccgcaacgtactacgtag

SEQ ID NO: 112 - protein, 406 aa, Artificial Sequence
  Variant of Leucine Decarboxylase from Planctomycetaceae bacterium
MGNLKFPDGALSPHDRRRLEDVYQYVREQCDTFIGYPCTMHFDYTPLLPFLAYPVNNVGDPFAASSYRVHTREIEREVLAWFAELMHIAPEEYWGYVTNGGTEGNLYGLFLARERFPTGVAYYSEDTHYSVYKNLRLLNMRHIMIKSQPNGEIDYGDLYETMRIHRDCPPIIFANIGTTMTEGIDNVRTIQDMFKKLAIHESHIHCDAALAGMTLPFMDDAPAFDFATGIDSLSISGHKFIGSPIPCGIVLTRKHYVERIARSIEYVGTLDTTITGSRNGITPLFLWYAVKQAGRDGFARRVAACLDNARYTVEQFKRIGVEARRNPCAITVVFPKPPQSVLHKWQIAVNGDRAHIILMPSTTLQHVDELIADIAAANKAAAAPSDTQKPAAKKRPTPAGAPQRTT

SEQ ID NO: 113 - DNA, 1221 bp, Artificial Sequence
  Variant of Leucine Decarboxylase from Planctomycetaceae bacterium
atgggtaatctgaaatttccagatggcgcgttgagcccgattgaccgccgccgtctggaagatgtgtatcagtacgttcgtgagcaatgcgacaccttcattgggtatccgtgtacgatgcactttgattacacacctcttttaccgttcctggcctatcccgtcaacaacgtaggcgatccgtttgctgcatccagttatcgcgtgcatacccgtgaaatcgaacgcgaggttctggcgtggttcgccgaactcatgcacattgcaccagaagaatactggggttatgtgactaatggaggaaccgagggcaacctgtacggtttgtttttagcgcgtgaacgctttcctacgggcgtcgcctactattcggaagacacccattatagcgtgtataagaatctgcgtctgctgaacatgcgtcacatcatgatcaaatcacagccgaatggtgagattgattacggcgatctctacgaaactatgcgcattcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgattccttgcggcatcgttttgacacgcaaacattatgtggagcgtattgctcgcagtatcgaatatgtcggtaccctggacactacgattaccggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgcgtcgtaatccatgcgccattaccgttgtgttcccgaaacctccgcagtcagtgctgcacaagtggcaaatcgcagttaacggcgaccgcgcgcatattattttaatgccaagtaccaccctccagcatgtcgatgaattgatcgctgacattgcagccgccaataaagcggctgcagcaccgagcgatacgcagaaacccgccgccaagaaacgcccgacaccggctggtgcaccgcaacgtactacgtag

SEQ ID NO: 114 - protein, 406 aa, Artificial Sequence
  Variant of Leucine Decarboxylase from Planctomycetaceae bacterium
MGNLKFPDGALSPIDRRRLEDVYQYVREQCDTFIGYPCTMHFDYTPLLPFLAYPVNNVGDPFAASSYRVHTREIEREVLAWFAELMHIAPEEYWGYVTNGGTEGNLYGLFLARERFPTGVAYYSEDTHYSVYKNLRLLNMRHIMIKSQPNGEIDYGDLYETMRIHRDCPPIIFANIGTTMTEGIDNVRTIQDMFKKLAIHESHIHCDAALAGMTLPFMDDAPAFDFATGIDSLSISGHKFIGSPIPCGIVLTRKHYVERIARSIEYVGTLDTTITGSRNGITPLFLWYAVKQAGRDGFKRRVAACLDNARYTVEQFKRIGVEARRNPCAITVVFPKPPQSVLHKWQIAVNGDRAHIILMPSTTLQHVDELIADIAAANKAAAAPSDTQKPAAKKRPTPAGAPQRTT

SEQ ID NO: 115 - DNA, 1221 bp, Artificial Sequence
  Variant of Leucine Decarboxylase from Planctomycetaceae bacterium
atgggtaatctgaaatttccagatggcgcgttgagcccgcatgaccgccgccgtctggaagatgtgtatcagtacgttcgtgagcaatgcgacaccttcattgggtatccgtgtacgatgcactttgattacacacctcttttaccgttcctggcctatcccgtcaacaacgtaggcgatccgtttgctgcatccagttatcgcgtgcatacccgtgaaatcgaacgcgaggttctggcgtggttcgccgaactcatgcacattgcaccagaagaatactggggttatgtgactaatggaggaaccgagggcaacctgtacggtttgtttttagcgcgtgaacgctttcctacgggcgtcgcctactattcggaagacacccattatagcgtgtataagaatctgcgtctgctgaacatgcgtcacatcatgatcaaatcacagccgaatggtgagattgattacggcgatctctacgaaactatgcgcattcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgattccttgcggcatcgttttgacacgcaaacattatgtggagcgtattgctcgcagtatcgaatatgtcggtaccctggacactacgattaccggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgcgtcgtaatccatgcgccattaccgttgtgttcccgaaacctccgcagtcagtgctgcacaagtggcaaatcgcagttaacggcgaccgcgcgcatattattttaatgccaagtaccaccttgcagcatgtcgatgaattgatcgctgacattgcagccgccaataaagcggctgcagcaccgagcgatacgcagaaacccgccgccaaggaacgcccgacaccggctggtgcaccgcaacgtactacgtag

SEQ ID NO: 116 - protein, 406 aa, Artificial Sequence
  Variant of Leucine Decarboxylase from Planctomycetaceae bacterium
MGNLKFPDGALSPHDRRRLEDVYQYVREQCDTFIGYPCTMHFDYTPLLPFLAYPVNNVGDPFAASSYRVHTREIEREVLAWFAELMHIAPEEYWGYVTNGGTEGNLYGLFLARERFPTGVAYYSEDTHYSVYKNLRLLNMRHIMIKSQPNGEIDYGDLYETMRIHRDCPPIIFANIGTTMTEGIDNVRTIQDMFKKLAIHESHIHCDAALAGMTLPFMDDAPAFDFATGIDSLSISGHKFIGSPIPCGIVLTRKHYVERIARSIEYVGTLDTTITGSRNGITPLFLWYAVKQAGRDGFKRRVAACLDNARYTVEQFKRIGVEARRNPCAITVVFPKPPQSVLHKWQIAVNGDRAHIILMPSTTLQHVDELIADIAAANKAAAAPSDTQKPAAKERPTPAGAPQRTT

SEQ ID NO: 117 - DNA, 1221 bp, Artificial Sequence
  Variant of Leucine Decarboxylase from Planctomycetaceae bacterium
atgggtaatctgaaatttccagatggcgcgttgagcccgcatgaccgccgccgtctggaagatgtgtatcagtacgttcgtgagcaatgcgacaccttcattgggtatccgtgtacgatgcactttgattacacacctcttttaccgttcctggcctatcccgtcaacaacgtaggcgatccgtttgctgcatccagttatcgcgtgcatacccgtgaaatcgaacgcgaggttctggcgtggttcgccgaactcatgcacattgcaccagaagaatactggggttatgtgactaatggaggaaccgagggcaacctgtacggtttgtttttagcgcgtgaacgctttcctacgggcgtcgcctactattcggaagacacccattatagcgtgtataagaatctgcgtctgctgaacatgcgtcacatcatgatcaaatcacagccgaatggtgagattgattacggcgatctctacgaaactatgcgcattcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgattccttgcggcatcgttttgacacgcaaacattatgtggagcgtattgctcgcagtatcgaatatgtcggtaccctggacactacgattaccggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgcgtcgtaatccatgcgccattaccgttgtgttcccgaaacctccgcagtcagtgctgcacaagtggcaaatcgcagttaacggcgaccgcgcgcatattattttaatgccaagtaccaccctccagcatgtcgatgaattgatcgctgacattgcagccgccaataaagcggctgcagcaccgagcgatacgcagaaacccgaggccaagaaacgcccgacaccggctggtgcaccgcaacgtactacgtag

SEQ ID NO: 118 - protein, 406 aa, Artificial Sequence
  Variant of Leucine Decarboxylase from Planctomycetaceae bacterium
MGNLKFPDGALSPHDRRRLEDVYQYVREQCDTFIGYPCTMHFDYTPLLPFLAYPVNNVGDPFAASSYRVHTREIEREVLAWFAELMHIAPEEYWGYVTNGGTEGNLYGLFLARERFPTGVAYYSEDTHYSVYKNLRLLNMRHIMIKSQPNGEIDYGDLYETMRIHRDCPPIIFANIGTTMTEGIDNVRTIQDMFKKLAIHESHIHCDAALAGMTLPFMDDAPAFDFATGIDSLSISGHKFIGSPIPCGIVLTRKHYVERIARSIEYVGTLDTTITGSRNGITPLFLWYAVKQAGRDGFKRRVAACLDNARYTVEQFKRIGVEARRNPCAITVVFPKPPQSVLHKWQIAVNGDRAHIILMPSTTLQHVDELIADIAAANKAAAAPSDTQKPEAKKRPTPAGAPQRTT

SEQ ID NO: 119 - DNA, 1221 bp, Artificial Sequence
  Variant of Leucine Decarboxylase from Planctomycetaceae bacterium
atgggtaatctgaaatttccagatggcgcgttgagcccgcatgaccgccgccgtctggaagatgtgtatcagtacgttcgtgagcaatgcgacaccttcattgggtatccgtgtacgatgcactttgattacacacctcttttaccgttcctggcctatcccgtcaacaacgtaggcgatccgtttgctgcatccagttatcgcgtgcatacccgtgaaatcgaacgcgaggttctggcgtggttcgccgaactcatgcacattgcaccagaagaatactggggttatgtgactaatggaggaaccgagggcaacctgtacggtttgtttttagcgcgtgaacgctttcctacgggcgtcgcctactattcggaagacacccattatagcgtgtataagaatctgcgtctgctgaacatgcgtcacatcatgatcaaatcacagccgaatggtgagattgattacggcgatctctacgaaactatgcgcattcatcgtgattgcccgccgatcatcttcgctaacattggtacgacgatgaccgaaggcattgacaacgtacgcaccatccaggatatgttcaagaggctggcgattcacgaatctcatatccattgtgacgcagcattagcggggatgaccctgccctttatggatgatgccccagcgtttgactttgccactggcattgattcgcttagcatctccggtcacaaattcattgggtctccgattccttgcggcatcgttttgacacgcaaacattatgtggagcgtattgctcgcagtatcgaatatgtcggtaccctggacactacgattaccggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgcgtcgtaatccatgcgccattaccgttgtgttcccgaaacctccgcagtcagtgctgcacaagtggcaaatcgcagttaacggcgaccgcgcgcatattattttaatgccaagtaccaccctccagcatgtcgatgaattgatcgctgacattgcagccgccaataaagcggctgcagcaccgagcgatacgcagaaacccgccgccaagaaacgcccgacaccggctggtgcaccgcaacgtactacgtag

SEQ ID NO: 120 - protein, 406 aa, Artificial Sequence
  Variant of Leucine Decarboxylase from Planctomycetaceae bacterium
MGNLKFPDGALSPHDRRRLEDVYQYVREQCDTFIGYPCTMHFDYTPLLPFLAYPVNNVGDPFAASSYRVHTREIEREVLAWFAELMHIAPEEYWGYVTNGGTEGNLYGLFLARERFPTGVAYYSEDTHYSVYKNLRLLNMRHIMIKSQPNGEIDYGDLYETMRIHRDCPPIIFANIGTTMTEGIDNVRTIQDMFKRLAIHESHIHCDAALAGMTLPFMDDAPAFDFATGIDSLSISGHKFIGSPIPCGIVLTRKHYVERIARSIEYVGTLDTTITGSRNGITPLFLWYAVKQAGRDGFKRRVAACLDNARYTVEQFKRIGVEARRNPCAITVVFPKPPQSVLHKWQIAVNGDRAHIILMPSTTLQHVDELIADIAAANKAAAAPSDTQKPAAKKRPTPAGAPQRTT

SEQ ID NO: 121 - DNA, 1221 bp, Artificial Sequence
  Variant of Leucine Decarboxylase from Planctomycetaceae bacterium
atgggtaatctgaaatttccagatggcgcgttgagcccgcatgaccgccgccgtctggaagatgtgtatcagtacgttcgtgagcaatgcgacaccttcattgggtatccgtgtacgatgcactttgattacacacctcttttaccgttcctggcctatcccgtcaacaacgtaggcgatccgtttgctgcatccagttatcgcgtgcatacccgtgaaatcgaacgcgaggttctggcgtggttcgccgaactcatgcacattgcaccagaagaatactggggttatgtgactaatggaggaaccgagggcaacctgtacggtttgtttttagcgcgtgaacgctttcctacgggcgtcgcctactattcggaagacacccattatagcgtgtataagaatctgcgtctgctgaacatgcgtcacatcatgatcaaatcacagccgaatggtgagattgattacggcgatctctacgaaactatgcgcattcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgattccttgcggcatcgttttgacacgcaaagggtatgtggagcgtattgctcgcagtatcgaatatgtcggtaccctggacactacgattaccggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgcgtcgtaatccatgcgccattaccgttgtgttcccgaaacctccgcagtcagtgctgcacaagtggcaaatcgcagttaacggcgaccgcgcgcatattattttaatgccaagtaccaccctccagcatgtcgatgaattgatcgctgacattgcagccgccaataaagcggctgcagcaccgagcgatacgcagaaacccgccgccaagaaacgcccgacaccggctggtgcaccgcaacgtactacgtag

SEQ ID NO: 122 - protein, 406 aa, Artificial Sequence
  Variant of Leucine Decarboxylase from Planctomycetaceae bacterium
MGNLKFPDGALSPHDRRRLEDVYQYVREQCDTFIGYPCTMHFDYTPLLPFLAYPVNNVGDPFAASSYRVHTREIEREVLAWFAELMHIAPEEYWGYVTNGGTEGNLYGLFLARERFPTGVAYYSEDTHYSVYKNLRLLNMRHIMIKSQPNGEIDYGDLYETMRIHRDCPPIIFANIGTTMTEGIDNVRTIQDMFKKLAIHESHIHCDAALAGMTLPFMDDAPAFDFATGIDSLSISGHKFIGSPIPCGIVLTRKGYVERIARSIEYVGTLDTTITGSRNGITPLFLWYAVKQAGRDGFKRRVAACLDNARYTVEQFKRIGVEARRNPCAITVVFPKPPQSVLHKWQIAVNGDRAHIILMPSTTLQHVDELIADIAAANKAAAAPSDTQKPAAKKRPTPAGAPQRTT

SEQ ID NO: 123 - DNA, 1221 bp, Artificial Sequence
  Variant of Leucine Decarboxylase from Planctomycetaceae bacterium
atgggtaatctgatgtttccagatggcgcgttgagcccgcatgaccgccgccgtctggaagatgtgtatcagtacgttcgtgagcaatgcgacaccttcattgggtatccgtgtacgatgcactttgattacacacctcttttaccgttcctggcctatcccgtcaacaacgtaggcgatccgtttgctgcatccagttatcgcgtgcatacccgtgaaatcgaacgcgaggttctggcgtggttcgccgaactcatgcacattgcaccagaagaatactggggttatgtgactaatggaggaaccgagggcaacctgtacggtttgtttttagcgcgtgaacgctttcctacgggcgtcgcctactattcggaagacacccattatagcgtgtataagaatctgcgtctgctgaacatgcgtcacatcatgatcaaatcacagccgaatggtgagattgattacggcgatctctacgaaactatgcgcattcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgattccttgcggcatcgttttgacacgcaaacattatgtggagcgtattgctcgcagtatcgaatatgtcggtaccctggacactacgattaccggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgcgtcgtaatccatgcgccattaccgttgtgttcccgaaacctccgcagtcagtgctgcacaagtggcaaatcgcagttaacggcgaccgcgcgcatattattttaatgccaagtaccaccctccagcatgtcgatgaattgatcgctgacattgcagccgccaataaagcggctgcagcaccgagcgatacgcagaaacccgccgccaagaaacgcccgacaccggctggtgcaccgcaacgtactacgtag

SEQ ID NO: 124 - protein, 406 aa, Artificial Sequence
  Variant of Leucine Decarboxylase from Planctomycetaceae bacterium
MGNLMFPDGALSPHDRRRLEDVYQYVREQCDTFIGYPCTMHFDYTPLLPFLAYPVNNVGDPFAASSYRVHTREIEREVLAWFAELMHIAPEEYWGYVTNGGTEGNLYGLFLARERFPTGVAYYSEDTHYSVYKNLRLLNMRHIMIKSQPNGEIDYGDLYETMRIHRDCPPIIFANIGTTMTEGIDNVRTIQDMFKKLAIHESHIHCDAALAGMTLPFMDDAPAFDFATGIDSLSISGHKFIGSPIPCGIVLTRKHYVERIARSIEYVGTLDTTITGSRNGITPLFLWYAVKQAGRDGFKRRVAACLDNARYTVEQFKRIGVEARRNPCAITVVFPKPPQSVLHKWQIAVNGDRAHIILMPSTTLQHVDELIADIAAANKAAAAPSDTQKPAAKKRPTPAGAPQRTT

SEQ ID NO: 125 - DNA, 1221 bp, Artificial Sequence
  Variant of Leucine Decarboxylase from Planctomycetaceae bacterium
atgggtaatctgaaatttccagatggcgcgttgagcccgcatgaccgccgccgtctggaagatgtgtatcagtacgttcgtgagcaatgcgacaccttcattgggtatccgtgtacgatgcactttgattacacacctcttttaccgttcctggcctatcccgtcaacaacgtaggcgatccgtttgctgcatccagttatcgcgtgcatacccgtgaaatcgaacgcgaggttctggcgtggttcgccgaactcatgcacattgcaccagaagaatactggggttatgtgactaatggaggaaccgagggcaacctgtacggtttgtttttagcgcgtgaacgctttcctacgggcgtcgcctactattcggaagacacccattatagcgtgtataagaatctgcgtctgctgaacatgcgtcacatcatgatcaaatcacagccgaatggtgagattgattacggcgatctctacgaaactatgcgcattcatcgtgattgcccgccgatcatcttcgctaacattggtacgacgatgaccgaaggcattgacaacgtacgcaccatccaggatatgttcaaggatctggcgattcacgaatctcatatccattgtgacgcagcattagcggggatgaccctgccctttatggatgatgccccagcgtttgactttgccactggcattgattcgcttagcatctccggtcacaaattcattgggtctccgattccttgcggcatcgttttgacacgcaaacattatgtggagcgtattgctcgcagtatcgaatatgtcggtaccctggacactacgattaccggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgcgtcgtaatccatgcgccattaccgttgtgttcccgaaacctccgcagtcagtgctgcacaagtggcaaatcgcagttaacggcgaccgcgcgcatattattttaatgccaagtaccaccctccagcatgtcgatgaattgatcgctgacattgcagccgccaataaagcggctgcagcaccgagcgatacgcagaaacccgccgccaagaaacgcccgacaccggctggtgcaccgcaacgtactacgtag

SEQ ID NO: 126 - protein, 406 aa, Artificial Sequence
  Variant of Leucine Decarboxylase from Planctomycetaceae bacterium
MGNLKFPDGALSPHDRRRLEDVYQYVREQCDTFIGYPCTMHFDYTPLLPFLAYPVNNVGDPFAASSYRVHTREIEREVLAWFAELMHIAPEEYWGYVTNGGTEGNLYGLFLARERFPTGVAYYSEDTHYSVYKNLRLLNMRHIMIKSQPNGEIDYGDLYETMRIHRDCPPIIFANIGTTMTEGIDNVRTIQDMFKDLAIHESHIHCDAALAGMTLPFMDDAPAFDFATGIDSLSISGHKFIGSPIPCGIVLTRKHYVERIARSIEYVGTLDTTITGSRNGITPLFLWYAVKQAGRDGFKRRVAACLDNARYTVEQFKRIGVEARRNPCAITVVFPKPPQSVLHKWQIAVNGDRAHIILMPSTTLQHVDELIADIAAANKAAAAPSDTQKPAAKKRPTPAGAPQRTT

SEQ ID NO: 127 - DNA, 1221 bp, Artificial Sequence
  Variant of Leucine Decarboxylase from Planctomycetaceae bacterium
atgggtaatctgaaatttccagatggcgcgttgagcccgcatgaccgccgccgtctggaagatgtgtatcagtacgttcgtgagcaatgcgacaccttcattgggtatccgtgtacgatgcactttgattacacacctcttttaccgttcctggcctatcccgtcaacaacgtaggcgatccgtttgctgcatccagttatcgcgtgcatacccgtgaaatcgaacgcgaggttctggcgtggttcgccgaactcatgcacattgcaccagaagaatactggggttatgtgactaatggaggaaccgagggcaacctgtacggtttgtttttagcgcgtgaacgctttcctacgggcgtcgcctactattcggaagacacccattatagcgtgtataagaatctgcgtctgctgaacatgcgtcacatcatgatcaaatcacagccgaatggtgagattgattacggcgatctctacgaaactatgcgcattcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgattccttgcggcatcgttttgacacgcaaacattatgtggagcgtattgctcgcagtatcgaatatgtcggtaccctggacactacgattaccggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgcgtcgtaatccatgcgccattaccgttgtgttcccgaaacctccgcagtcagtgctgcacaagtggcaaatcgcagttaacggcgaccgcgcgcatattattttaatgccaagtaccaccctccagcatgtcgatgaattgatcgctgacattgcagccgccaataaagcggctgcagcaccgagcgatacgcagaaacccgccgccaagaaaaagccgacaccggctggtgcaccgcaacgtactacgtag

SEQ ID NO: 128 - protein, 406 aa, Artificial Sequence
  Variant of Leucine Decarboxylase from Planctomycetaceae bacterium
MGNLKFPDGALSPHDRRRLEDVYQYVREQCDTFIGYPCTMHFDYTPLLPFLAYPVNNVGDPFAASSYRVHTREIEREVLAWFAELMHIAPEEYWGYVTNGGTEGNLYGLFLARERFPTGVAYYSEDTHYSVYKNLRLLNMRHIMIKSQPNGEIDYGDLYETMRIHRDCPPIIFANIGTTMTEGIDNVRTIQDMFKKLAIHESHIHCDAALAGMTLPFMDDAPAFDFATGIDSLSISGHKFIGSPIPCGIVLTRKHYVERIARSIEYVGTLDTTITGSRNGITPLFLWYAVKQAGRDGFKRRVAACLDNARYTVEQFKRIGVEARRNPCAITVVFPKPPQSVLHKWQIAVNGDRAHIILMPSTTLQHVDELIADIAAANKAAAAPSDTQKPAAKKKPTPAGAPQRTT

SEQ ID NO: 129 - DNA, 1221 bp, Artificial Sequence
  Variant of Leucine Decarboxylase from Planctomycetaceae bacterium
atgggtaatctgaaatttccagatggcgcgttgagcccgcatgaccgccgccgtctggaagatgtgtatcagtacgttcgtgagcaatgcgacaccttcattgggtatccgtgtacgatgcactttgattacacacctcttttaccgttcctggcctatcccgtcaacaacgtaggcgatccgtttgctgcatccagttatcgcgtgcatacccgtgaaatcgaacgcgaggttctggcgtggttcgccgaactcatgcacattgcaccagaagaatactggggttatgtgactaatggaggaaccgagggcaacctgtacggtttgtttttagcgcgtgaacgctttcctacgggcgtcgcctactattcggaagacacccattatagcgtgtataagaatctgcgtctgctgaacatgcgtcacatcatgatcaaatcacagccgaatggtgagattgattacggcgatctctacgaaactatgcgcattcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgattccttgcggcatcgttttgacacgcaaacattatgtggagcgtattgctcgcagtatcgaatatgtcggtaccctggacactacgattaccggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgcgtcgtaatccatgcgccattaccgttgtgttcccgaaacctccgcagtcagtgctggctaagtggcaaatcgcagttaacggcgaccgcgcgcatattattttaatgccaagtaccaccctccagcatgtcgatgaattgatcgctgacattgcagccgccaataaagcggctgcagcaccgagcgatacgcagaaacccgccgccaagaaacgcccgacaccggctggtgcaccgcaacgtactacgtag

SEQ ID NO: 130 - protein, 406 aa, Artificial Sequence
  Variant of Leucine Decarboxylase from Planctomycetaceae bacterium
MGNLKFPDGALSPHDRRRLEDVYQYVREQCDTFIGYPCTMHFDYTPLLPFLAYPVNNVGDPFAASSYRVHTREIEREVLAWFAELMHIAPEEYWGYVTNGGTEGNLYGLFLARERFPTGVAYYSEDTHYSVYKNLRLLNMRHIMIKSQPNGEIDYGDLYETMRIHRDCPPIIFANIGTTMTEGIDNVRTIQDMFKKLAIHESHIHCDAALAGMTLPFMDDAPAFDFATGIDSLSISGHKFIGSPIPCGIVLTRKHYVERIARSIEYVGTLDTTITGSRNGITPLFLWYAVKQAGRDGFKRRVAACLDNARYTVEQFKRIGVEARRNPCAITVVFPKPPQSVLAKWQIAVNGDRAHIILMPSTTLQHVDELIADIAAANKAAAAPSDTQKPAAKKRPTPAGAPQRTT

SEQ ID NO: 131 - DNA, 1221 bp, Artificial Sequence
  Variant of Leucine Decarboxylase from Planctomycetaceae bacterium
atgggtaatctgaaatttccagatggcgcgttgagcccgcatgaccgccgccgtctggaagatgtgtatcagtacgttcgtgagcaatgcgacaccttcattgggtatccgtgtacgatgcactttgattacacacctcttttaccgttcctggcctatcccgtcaacaacgtaggcgatccgtttgctgcatccagttatcgcgtgcatacccgtgaaatcgaacgcgaggttctggcgtggttcgccgaactcatgcacattgcaccagaagaatactggggttatgtgactaatggaggaaccgagggcaacctgtacggtttgtttttagcgcgtgaacgctttcctacgggcgtcgcctactattcggaagacacccattatagcgtgtataagaatctgcgtctgctgaacatgcgtcacatcatgatcaaatcacagccgaatggtgagattgattacggcgatctctacgaaactatgcgcattcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgattccttgcggcatcgttttgacacgcaaacattatgtggagcgtattgctcgcagtatcgaatatgtcggtaccctggacactacgattaccggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgcgccattaccgttgtgttcccgaaacctccgcagtcagtgctgcacaagtggcaaatcgcagttaacggcgaccgcgcgcatattattttaatgccaagtaccaccctccagcatgtcgatgaattgatcgctgacattgcagccgccaataaagcggctgcagcaccgagcgatacgcagaaacccgccgccaagaaacgcccgacaccggctggtgcaccgcaacgtactacgtag

SEQ ID NO: 132 - protein, 406 aa, Artificial Sequence
  Variant of Leucine Decarboxylase from Planctomycetaceae bacterium
MGNLKFPDGALSPHDRRRLEDVYQYVREQCDTFIGYPCTMHFDYTPLLPFLAYPVNNVGDPFAASSYRVHTREIEREVLAWFAELMHIAPEEYWGYVTNGGTEGNLYGLFLARERFPTGVAYYSEDTHYSVYKNLRLLNMRHIMIKSQPNGEIDYGDLYETMRIHRDCPPIIFANIGTTMTEGIDNVRTIQDMFKKLAIHESHIHCDAALAGMTLPFMDDAPAFDFATGIDSLSISGHKFIGSPIPCGIVLTRKHYVERIARSIEYVGTLDTTITGSRNGITPLFLWYAVKQAGRDGFKRRVAACLDNARYTVEQFKRIGVEAMRNPCAITVVFPKPPQSVLHKWQIAVNGDRAHIILMPSTTLQHVDELIADIAAANKAAAAPSDTQKPAAKKRPTPAGAPQRTT

SEQ ID NO: 133 - DNA, 1221 bp, Artificial Sequence
  Variant of Leucine Decarboxylase from Planctomycetaceae bacterium
atgggtaatctgaaatttccagatggcgcgttgagcccgcatgaccgccgccgtctggaagatgtgtatcagtacgttcgtgagcaatgcgacaccttcattgggtatccgtgtacgatgcactttgattacacacctcttttaccgttcctggcctatcccgtcaacaacgtaggcgatccgtttgctgcatccagttatcgcgtgcatacccgtgaaatcgaacgcgaggttctggcgtggttcgccgaactcatgcacattgcaccagaagaatactggggttatgtgactaatggaggaaccgagggcaacctgtacggtttgtttttagcgcgtgaacgctttcctacgggcgtcgcctactattcggaagacacccattatagcgtgtataagaatctgcgtctgctgaacatgcgtcacatcatgatcaaatcacagccgaatggtgagattgattacggcgatctctacgaaactatgcgcattcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgattccttgcggcatcgttttgacacgcaaacattatgtggagcgtattgctcgcagtatcgaatatgtcggtaccctggacactacgattaccggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgcgtcgtaatccatgcgccattaccgttgtgttcccgaaacctccgcagtcagtgctgcacaagtggcaaatcgcagttaacggcgacgaggcgcatattattttaatgccaagtaccaccctccagcatgtcgatgaattgatcgctgacattgcagccgccaataaagcggctgcagcaccgagcgatacgcagaaacccgccgccaagaaacgcccgacaccggctggtgcaccgcaacgtactacgtag

SEQ ID NO: 134 - protein, 406 aa, Artificial Sequence
  Variant of Leucine Decarboxylase from Planctomycetaceae bacterium
MGNLKFPDGALSPHDRRRLEDVYQYVREQCDTFIGYPCTMHFDYTPLLPFLAYPVNNVGDPFAASSYRVHTREIEREVLAWFAELMHIAPEEYWGYVTNGGTEGNLYGLFLARERFPTGVAYYSEDTHYSVYKNLRLLNMRHIMIKSQPNGEIDYGDLYETMRIHRDCPPIIFANIGTTMTEGIDNVRTIQDMFKKLAIHESHIHCDAALAGMTLPFMDDAPAFDFATGIDSLSISGHKFIGSPIPCGIVLTRKHYVERIARSIEYVGTLDTTITGSRNGITPLFLWYAVKQAGRDGFKRRVAACLDNARYTVEQFKRIGVEARRNPCAITVVFPKPPQSVLHKWQIAVNGDEAHIILMPSTTLQHVDELIADIAAANKAAAAPSDTQKPAAKKRPTPAGAPQRTT

SEQ ID NO: 135 - DNA, 1221 bp, Artificial Sequence
  Variant of Leucine Decarboxylase from Planctomycetaceae bacterium
atgggtaatctgaaatttccagatggcgcgttgagcccgcatgaccgccgccgtctggaagatgtgtatcagtacgttcgtgagcaatgcgacaccttcattgggtatccgtgtacgatgcactttgattacacacctcttttaccgttcctggcctatcccgtcaacaacgtaggcgatccgtttgctgcatccagttatcgcgtgcatacccgtgaaatcgaacgcgaggttctggcgtggttcgccgaactcatgcacattgcaccagaagaatactggggttatgtgactaatggaggaaccgagggcaacctgtacggtttgtttttagcgcgtgaacgctttcctacgggcgtcgcctactattcggaagacacccattatagcgtgtataagaatctgcgtctgctgaacatgcgtcacatcatgatcaaatcacagccgaatggtgagattgattacggcgatctctacgaaactatgcgcattcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgattccttgcggcatcgttttgacacgcaaacattatgtggagcgtattgctcgcagtatcgaatatgtcggtaccctggacactacgattaccggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgcgtcgtaatccatgcgccattaccgttgtgttcccgaaacctccgcagtcagtgctgcacaagtggcaaatcgcagttaacggcgaccgcgcgcatattattttaatgccaagtaccaccaggcagcatgtcgatgaattgatcgctgacattgcagccgccaataaagcggctgcagcaccgagcgatacgcagaaacccgccgccaagaaacgcccgacaccggctggtgcaccgcaacgtactacgtag

SEQ ID NO: 136 - protein, 406 aa, Artificial Sequence
  Variant of Leucine Decarboxylase from Planctomycetaceae bacterium
MGNLKFPDGALSPHDRRRLEDVYQYVREQCDTFIGYPCTMHFDYTPLLPFLAYPVNNVGDPFAASSYRVHTREIEREVLAWFAELMHIAPEEYWGYVTNGGTEGNLYGLFLARERFPTGVAYYSEDTHYSVYKNLRLLNMRHIMIKSQPNGEIDYGDLYETMRIHRDCPPIIFANIGTTMTEGIDNVRTIQDMFKKLAIHESHIHCDAALAGMTLPFMDDAPAFDFATGIDSLSISGHKFIGSPIPCGIVLTRKHYVERIARSIEYVGTLDTTITGSRNGITPLFLWYAVKQAGRDGFKRRVAACLDNARYTVEQFKRIGVEARRNPCAITVVFPKPPQSVLHKWQIAVNGDRAHIILMPSTTRQHVDELIADIAAANKAAAAPSDTQKPAAKKRPTPAGAPQRTT

SEQ ID NO: 137 - DNA, 1221 bp, Artificial Sequence
  Variant of Leucine Decarboxylase from Planctomycetaceae bacterium
atgggtaatctgaaatttccagatggcgcgttgagcccgcatgaccgccgccgtctggaagatgtgtatcagtacgttcgtgagcaatgcgacaccttcattgggtatccgtgtacgatgcactttgattacacacctcttttaccgttcctggcctatcccgtcaacaacgtaggcgatccgtttgctgcatccagttatcgcgtgcatacccgtgaaatcgaacgcgaggttctggcgtggttcgccgaactcatgcacattgcaccagaagaatactggggttatgtgactaatggaggaaccgagggcaacctgtacggtttgtttttagcgcgtgaacgctttcctacgggcgtcgcctactattcggaagacacccattatagcgtgtataagaatctgcgtctgctgaacatgcgtcacatcatgatcaaatcacagccgaatggtgagattgattacggcgatctctacgaaactatgcgcattcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgattccttgcggcatcgttttgacacgcaaacattatgtggagcgtattgctcgcagtatcgaatatgtcggtaccctggacactacgattaccggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgcgtcgtaatccatgcgccattaccgttgtgttcccgaaacctccgcagtcagtgctgcacaagtggcaaatcgcagttaacggcgaccgcgcgcatattattttaatgccaagtaccaccctccagcatgtcgatgaattgatcgctgacattgcagccgccaataaagcggctgcagcaccgagcgatacgcaggagcccgccgccaagaaacgcccgacaccggctggtgcaccgcaacgtactacgtag

SEQ ID NO: 138 - protein, 406 aa, Artificial Sequence
  Variant of Leucine Decarboxylase from Planctomycetaceae bacterium
MGNLKFPDGALSPHDRRRLEDVYQYVREQCDTFIGYPCTMHFDYTPLLPFLAYPVNNVGDPFAASSYRVHTREIEREVLAWFAELMHIAPEEYWGYVTNGGTEGNLYGLFLARERFPTGVAYYSEDTHYSVYKNLRLLNMRHIMIKSQPNGEIDYGDLYETMRIHRDCPPIIFANIGTTMTEGIDNVRTIQDMFKKLAIHESHIHCDAALAGMTLPFMDDAPAFDFATGIDSLSISGHKFIGSPIPCGIVLTRKHYVERIARSIEYVGTLDTTITGSRNGITPLFLWYAVKQAGRDGFKRRVAACLDNARYTVEQFKRIGVEARRNPCAITVVFPKPPQSVLHKWQIAVNGDRAHIILMPSTTLQHVDELIADIAAANKAAAAPSDTQEPAAKKRPTPAGAPQRTT

SEQ ID NO: 139 - DNA, 1221 bp, Artificial Sequence
  Variant of Leucine Decarboxylase from Planctomycetaceae bacterium
atgggtaatctgaaatttccagatggcgcgttgagcccgcatgaccgccgccgtctggaagatgtgtatcagtacgttcgtgagcaatgcgacaccttcattgggtatccgtgtacgatgcactttgattacacacctcttttaccgttcctggcctatcccgtcaacaacgtaggcgatccgtttgctgcatccagttatcgcgtgcatacccgtgaaatcgaacgcgaggttctggcgtggttcgccgaactcatgcacattgcaccagaagaatactggggttatgtgactaatggaggaaccgagggcaacctgtacggtttgtttttagcgcgtgaacgctttcctacgggcgtcgcctactattcggaagacacccattatagcgtgtataagaatctgcgtctgctgaacatgcgtcacatcatgatcaaatcacagccgaatggtgagattgattacggcgatctctacgaaactatgcgcattcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgattccttgcggcatcgttttgacacgcaaacattatgtggagcgtattgctcgcagtatcgaatatgtcggtaccctggacactacgattaccggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgcgtcgtaatccatgcgccattaccgttgtgttcccgaaacctccgcagtcagtgctgcacaagtggcaaatcgcagttagtggcgaccgcgcgcatattattttaatgccaagtaccaccctccagcatgtcgatgaattgatcgctgacattgcagccgccaataaagcggctgcagcaccgagcgatacgcagaaacccgccgccaagaaacgcccgacaccggctggtgcaccgcaacgtactacgtag

SEQ ID NO: 140 - protein, 406 aa, Artificial Sequence
  Variant of Leucine Decarboxylase from Planctomycetaceae bacterium
MGNLKFPDGALSPHDRRRLEDVYQYVREQCDTFIGYPCTMHFDYTPLLPFLAYPVNNVGDPFAASSYRVHTREIEREVLAWFAELMHIAPEEYWGYVTNGGTEGNLYGLFLARERFPTGVAYYSEDTHYSVYKNLRLLNMRHIMIKSQPNGEIDYGDLYETMRIHRDCPPIIFANIGTTMTEGIDNVRTIQDMFKKLAIHESHIHCDAALAGMTLPFMDDAPAFDFATGIDSLSISGHKFIGSPIPCGIVLTRKHYVERIARSIEYVGTLDTTITGSRNGITPLFLWYAVKQAGRDGFKRRVAACLDNARYTVEQFKRIGVEARRNPCAITVVFPKPPQSVLHKWQIAVSGDRAHIILMPSTTLQHVDELIADIAAANKAAAAPSDTQKPAAKKRPTPAGAPQRTT

SEQ ID NO: 141 - DNA, 1221 bp, Artificial Sequence
  Variant of Leucine Decarboxylase from Planctomycetaceae bacterium
atgggtaatctgaaatttccagatggcgcgttgagcccgcatgaccgccgccgtctggaagatgtgtatcagtacgttcgtgagcaatgcgacaccttcattgggtatccgtgtacgatgcactttgattacacacctcttttaccgttcctggcctatcccgtcaacaacgtaggcgatccgtttgctgcatccagttatcgcgtgcatacccgtgaaatcgaacgcgaggttctggcgtggttcgccgaactcatgcacattgcaccagaagaatactggggttatgtgactaatggaggaaccgagggcaacctgtacggtttgtttttagcgcgtgaacgctttcctacgggcgtcgcctactattcggaagacacccattatagcgtgtataagaatctgcgtctgctgaacatgcgtcacatcatgatcaaatcacagccgaatggtgagattgattacggcgatctctacgaaactatgcgctgtcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgattccttgcggcatcgttttgacacgcaaacattatgtggagcgtattgctcgcagtatcgaatatgtcggtaccctggacactacgattaccggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgcgtcgtaatccatgcgccattaccgttgtgttcccgaaacctccgcagtcagtgctgcacaagtggcaaatcgcagttaacggcgaccgcgcgcatattattttaatgccaagtaccaccctccagcatgtcgatgaattgatcgctgacattgcagccgccaataaagcggctgcagcaccgagcgatacgcagaaacccgccgccaagaaacgcccgacaccggctggtgcaccgcaacgtactacgtag

SEQ ID NO: 142 - protein, 406 aa, Artificial Sequence
  Variant of Leucine Decarboxylase from Planctomycetaceae bacterium
MGNLKFPDGALSPHDRRRLEDVYQYVREQCDTFIGYPCTMHFDYTPLLPFLAYPVNNVGDPFAASSYRVHTREIEREVLAWFAELMHIAPEEYWGYVTNGGTEGNLYGLFLARERFPTGVAYYSEDTHYSVYKNLRLLNMRHIMIKSQPNGEIDYGDLYETMRCHRDCPPIIFANIGTTMTEGIDNVRTIQDMFKKLAIHESHIHCDAALAGMTLPFMDDAPAFDFATGIDSLSISGHKFIGSPIPCGIVLTRKHYVERIARSIEYVGTLDTTITGSRNGITPLFLWYAVKQAGRDGFKRRVAACLDNARYTVEQFKRIGVEARRNPCAITVVFPKPPQSVLHKWQIAVNGDRAHIILMPSTTLQHVDELIADIAAANKAAAAPSDTQKPAAKKRPTPAGAPQRTT

SEQ ID NO: 143 - DNA, 1221 bp, Artificial Sequence
  Variant of Leucine Decarboxylase from Planctomycetaceae bacterium
atgggtaatctgaaatttccagatggcgcgttgagcccgcatgaccgccgccgtctggaagatgtgtatcagtacgttcgtgagcaatgcgacaccttcattgggtatccgtgtacgatgcactttgattacacacctcttttaccgttcctggcctatcccgtcaacaacgtaggcgatccgtttgctgcatccagttatcgcgtgcatacccgtgaaatcgaacgcgaggttctggcgtggttcgccgaactcatgcacattgcaccagaagaatactggggttatgtgactaatggaggaaccgagggcaacctgtacggtttgtttttagcgcgtgaacgctttcctacgggcgtcgcctactattcggaagacacccattatagcgtgtataagaatctgcgtctgctgaacatgcgtcacatcatgatcaaatcacagccgaatggtgagattgattacggcgatctctacgaaactatgcgcattcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgattccttgcggcatcgttttgacacgcaaacattatgtggagcgtattgctcgcagtatcgaatatgtcggtaccctggacactacgattaccggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgcgtcgtaatccatgcgccattaccgttgtgttcccgaaacctccgcagtcagtgctgcacaagtggcaaatcgcagttaacggcgaccgcgcgcatattattttaatgccaagtaccaccctccagcatgtcgatgaattgatcgctgacattgcagccgccaataaagcggctgcagcaccgagcgatacgcagaaacccgccgccaagaaagctccgacaccggctggtgcaccgcaacgtactacgtag

SEQ ID NO: 144 - protein, 406 aa, Artificial Sequence
  Variant of Leucine Decarboxylase from Planctomycetaceae bacterium
MGNLKFPDGALSPHDRRRLEDVYQYVREQCDTFIGYPCTMHFDYTPLLPFLAYPVNNVGDPFAASSYRVHTREIEREVLAWFAELMHIAPEEYWGYVTNGGTEGNLYGLFLARERFPTGVAYYSEDTHYSVYKNLRLLNMRHIMIKSQPNGEIDYGDLYETMRIHRDCPPIIFANIGTTMTEGIDNVRTIQDMFKKLAIHESHIHCDAALAGMTLPFMDDAPAFDFATGIDSLSISGHKFIGSPIPCGIVLTRKHYVERIARSIEYVGTLDTTITGSRNGITPLFLWYAVKQAGRDGFKRRVAACLDNARYTVEQFKRIGVEARRNPCAITVVFPKPPQSVLHKWQIAVNGDRAHIILMPSTTLQHVDELIADIAAANKAAAAPSDTQKPAAKKAPTPAGAPQRTT

SEQ ID NO: 145 - DNA, 1221 bp, Artificial Sequence
  Variant of Leucine Decarboxylase from Planctomycetaceae bacterium
atgggtaatctgaaatttccagatggcgcgttgagcccgcatgaccgccgccgtctggaagatgtgtatcagtacgttcgtgagcaatgcgacaccttcattgggtatccgtgtacgatgcactttgattacacacctcttttaccgttcctggcctatcccgtcaacaacgtaggcgatccgtttgctgcatccagttatcgcgtgcatacccgtgaaatcgaacgcgaggttctggcgtggttcgccgaactcatgcacattgcaccagaagaatactggggttatgtgactaatggaggaaccgagggcaacctgtacggtttgtttttagcgcgtgaacgctttcctacgggcgtcgcctactattcggaagacacccattatagcgtgtataagaatctgcgtctgctgaacatgcgtcacatcatgatcaaatcacagccgaatggtgagattgattacggcgatctctacgaaactatgcgcattcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgattccttgcggcatcgttttgacacgcaaaccttatgtggagcgtattgctcgcagtatcgaatatgtcggtaccctggacactacgattaccggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgcgtcgtaatccatgcgccattaccgttgtgttcccgaaacctccgcagtcagtgctgcacaagtggcaaatcgcagttaacggcgaccgcgcgcatattattttaatgccaagtaccaccctccagcatgtcgatgaattgatcgctgacattgcagccgccaataaagcggctgcagcaccgagcgatacgcagaaacccgccgccaagaaacgcccgacaccggctggtgcaccgcaacgtactacgtag

SEQ ID NO: 146 - protein, 406 aa, Artificial Sequence
  Variant of Leucine Decarboxylase from Planctomycetaceae bacterium
MGNLKFPDGALSPHDRRRLEDVYQYVREQCDTFIGYPCTMHFDYTPLLPFLAYPVNNVGDPFAASSYRVHTREIEREVLAWFAELMHIAPEEYWGYVTNGGTEGNLYGLFLARERFPTGVAYYSEDTHYSVYKNLRLLNMRHIMIKSQPNGEIDYGDLYETMRIHRDCPPIIFANIGTTMTEGIDNVRTIQDMFKKLAIHESHIHCDAALAGMTLPFMDDAPAFDFATGIDSLSISGHKFIGSPIPCGIVLTRKPYVERIARSIEYVGTLDTTITGSRNGITPLFLWYAVKQAGRDGFKRRVAACLDNARYTVEQFKRIGVEARRNPCAITVVFPKPPQSVLHKWQIAVNGDRAHIILMPSTTLQHVDELIADIAAANKAAAAPSDTQKPAAKKRPTPAGAPQRTT

SEQ ID NO: 147 - DNA, 1221 bp, Artificial Sequence
  Variant of Leucine Decarboxylase from Planctomycetaceae bacterium
atgggtaatctgaaatttccagatggcgcgttgagcccgcatgaccgccgccgtctggaagatgtgtatcagtacgttcgtgagcaatgcgacaccttcattgggtatccgtgtacgatgcactttgattacacacctcttttaccgttcctggcctatcccgtcaacaacgtaggcgatccgtttgctgcatccagttatcgcgtgcatacccgtgaaatcgaacgcgaggttctggcgtggttcgccgaactcatgcacattgcaccagaagaatactggggttatgtgactaatggaggaaccgagggcaacctgtacggtttgtttttagcgcgtgaacgctttcctacgggcgtcgcctactattcggaagacacccattatagcgtgtataagaatctgcgtctgctgaacatgcgtcacatcatgatcaaatcacagccgaatggtgagattgattacggcgatctctacgaaactatgcgcgcgcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgattccttgcggcatcgttttgacacgcaaacattatgtggagcgtattgctcgcagtatcgaatatgtcggtaccctggacactacgattaccggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgcgtcgtaatccatgcgccattaccgttgtgttcccgaaacctccgcagtcagtgctgcacaagtggcaaatcgcagttaacggcgaccgcgcgcatattattttaatgccaagtaccaccctccagcatgtcgatgaattgatcgctgacattgcagccgccaataaagcggctgcagcaccgagcgatacgcagaaacccgccgccaagaaacgcccgacaccggctggtgcaccgcaacgtactacgtag

SEQ ID NO: 148 - protein, 406 aa, Artificial Sequence
  Variant of Leucine Decarboxylase from Planctomycetaceae bacterium
MGNLKFPDGALSPHDRRRLEDVYQYVREQCDTFIGYPCTMHFDYTPLLPFLAYPVNNVGDPFAASSYRVHTREIEREVLAWFAELMHIAPEEYWGYVTNGGTEGNLYGLFLARERFPTGVAYYSEDTHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPIPCGIVLTRKHYVERIARSIEYVGTLDTTITGSRNGITPLFLWYAVKQAGRDGFKRRVAACLDNARYTVEQFKRIGVEARRNPCAITVVFPKPPQSVLHKWQIAVNGDRAHIILMPSTTLQHVDELIADIAAANKAAAAPSDTQKPAAKKRPTPAGAPQRTT

SEQ ID NO: 149 - DNA, 1221 bp, Artificial Sequence
  Variant of Leucine Decarboxylase from Planctomycetaceae bacterium
atgggtaatctgaaatttccagatggcgcgttgagcccgcatgaccgccgccgtctggaagatgtgtatcagtacgttcgtgagcaatgcgacaccttcattgggtatccgtgtacgatgcactttgattacacacctcttttaccgttcctggcctatcccgtcaacaacgtaggcgatccgtttgctgcatccagttatcgcgtgcatacccgtgaaatcgaacgcgaggttctggcgtggttcgccgaactcatgcacattgcaccagaagaatactggggttatgtgactaatggaggaaccgagggcaacctgtacggtttgtttttagcgcgtgaacgctttcctacgggcgtcgcctactattcggaagacacccattatagcgtgtataagaatctgcgtctgctgaacatgcgtcacatcatgatcaaatcacagccgaatggtgagattgattacggcgatctctacgaaactatgcgcattcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgattccttgcggcatcgttttgacacgcaaacattatgtggagcgtattgctcgcagtatcgaatatgtcggtaccctggacactacgattaccggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgcgtcgtaatccatgcgccattaccgttgtgttcccgaaacctccgcagtcagtgctgcacaagtggcaaatcgcagttaacggcgaccgcgcgcatattattttaatgccaagtaccaccctccagcatgtcgatgaattgatcgctgacattgcagccgccaataaagcggctgcagcaccgagcgatacgcagcctcccgccgccaagaaacgcccgacaccggctggtgcaccgcaacgtactacgtag

SEQ ID NO: 150 - protein, 406 aa, Artificial Sequence
  Variant of Leucine Decarboxylase from Planctomycetaceae bacterium
MGNLKFPDGALSPHDRRRLEDVYQYVREQCDTFIGYPCTMHFDYTPLLPFLAYPVNNVGDPFAASSYRVHTREIEREVLAWFAELMHIAPEEYWGYVTNGGTEGNLYGLFLARERFPTGVAYYSEDTHYSVYKNLRLLNMRHIMIKSQPNGEIDYGDLYETMRIHRDCPPIIFANIGTTMTEGIDNVRTIQDMFKKLAIHESHIHCDAALAGMTLPFMDDAPAFDFATGIDSLSISGHKFIGSPIPCGIVLTRKHYVERIARSIEYVGTLDTTITGSRNGITPLFLWYAVKQAGRDGFKRRVAACLDNARYTVEQFKRIGVEARRNPCAITVVFPKPPQSVLHKWQIAVNGDRAHIILMPSTTLQHVDELIADIAAANKAAAAPSDTQPPAAKKRPTPAGAPQRTT

SEQ ID NO: 151 - DNA, 1221 bp, Artificial Sequence
  Variant of Leucine Decarboxylase from Planctomycetaceae bacterium
atgggtaatctgaaatttccagatggcgcgttgagcccgcatgaccgccgccgtctggaagatgtgtatcagtacgttcgtgagcaatgcgacaccttcattgggtatccgtgtacgatgcactttgattacacacctcttttaccgttcctggcctatcccgtcaacaacgtaggcgatccgtttgctgcatccagttatcgcgtgcatacccgtgaaatcgaacgcgaggttctggcgtggttcgccgaactcatgcacattgcaccagaagaatactggggttatgtgactaatggaggaaccgagggcaacctgtacggtttgtttttagcgcgtgaacgctttcctacgggcgtcgcctactattcggaagacacccattatagcgtgtataagaatctgcgtctgctgaacatgcgtcacatcatgatcaaatcacagccgaatggtgagattgattacggcgatctctacgaaactatgcgcattcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgattccttgcggcatcgttttgacacgcaaacattatgtggagcgtattgctcgcagtatcgaatatgtcggtaccctggacactacgattaccggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgcgtcgtaatccatgcgccattaccgttgtgttcccgaaacctccgcagtcagtgctgcacaagtggcaaatcgcagttaacggcgaccgcgcgcatattattttaatgccaagtaccaccctccagcatgtcgatgaattgatcgctgacattgcagccgccaatgatgcggctgcagcaccgagcgatacgcagaaacccgccgccaagaaacgcccgacaccggctggtgcaccgcaacgtactacgtag

SEQ ID NO: 152 - protein, 406 aa, Artificial Sequence
  Variant of Leucine Decarboxylase from Planctomycetaceae bacterium
MGNLKFPDGALSPHDRRRLEDVYQYVREQCDTFIGYPCTMHFDYTPLLPFLAYPVNNVGDPFAASSYRVHTREIEREVLAWFAELMHIAPEEYWGYVTNGGTEGNLYGLFLARERFPTGVAYYSEDTHYSVYKNLRLLNMRHIMIKSQPNGEIDYGDLYETMRIHRDCPPIIFANIGTTMTEGIDNVRTIQDMFKKLAIHESHIHCDAALAGMTLPFMDDAPAFDFATGIDSLSISGHKFIGSPIPCGIVLTRKHYVERIARSIEYVGTLDTTITGSRNGITPLFLWYAVKQAGRDGFKRRVAACLDNARYTVEQFKRIGVEARRNPCAITVVFPKPPQSVLHKWQIAVNGDRAHIILMPSTTLQHVDELIADIAAANDAAAAPSDTQKPAAKKRPTPAGAPQRTT

SEQ ID NO: 153 - DNA, 1221 bp, Artificial Sequence
  Variant of Leucine Decarboxylase from Planctomycetaceae bacterium
atgggtaatctgaaatttccagatggcgcgttgagcccgcatgaccgccgccgtctggaagatgtgtatcagtacgttcgtgagcaatgcgacaccttcattgggtatccgtgtacgatgcactttgattacacacctcttttaccgttcctggcctatcccgtcaacaacgtaggcgatccgtttgctgcatccagttatcgcgtgcatacccgtgaaatcgaacgcgaggttctggcgtggttcgccgaactcatgcacattgcaccagaagaatactggggttatgtgactaatggaggaaccgagggcaacctgtacggtttgtttttagcgcgtgaacgctttcctacgggcgtcgcctactattcggaagacacccattatagcgtgtataagaatctgcgtctgctgaacatgcgtcacatcatgatcaaatcacagccgaatggtgagattgattacggcgatctctacgaaactatgcgcattcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgattccttgcggcatcgttttgacacgcaaaaattatgtggagcgtattgctcgcagtatcgaatatgtcggtaccctggacactacgattaccggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgcgtcgtaatccatgcgccattaccgttgtgttcccgaaacctccgcagtcagtgctgcacaagtggcaaatcgcagttaacggcgaccgcgcgcatattattttaatgccaagtaccaccctccagcatgtcgatgaattgatcgctgacattgcagccgccaataaagcggctgcagcaccgagcgatacgcagaaacccgccgccaagaaacgcccgacaccggctggtgcaccgcaacgtactacgtag

SEQ ID NO: 154 - protein, 406 aa, Artificial Sequence
  Variant of Leucine Decarboxylase from Planctomycetaceae bacterium
MGNLKFPDGALSPHDRRRLEDVYQYVREQCDTFIGYPCTMHFDYTPLLPFLAYPVNNVGDPFAASSYRVHTREIEREVLAWFAELMHIAPEEYWGYVTNGGTEGNLYGLFLARERFPTGVAYYSEDTHYSVYKNLRLLNMRHIMIKSQPNGEIDYGDLYETMRIHRDCPPIIFANIGTTMTEGIDNVRTIQDMFKKLAIHESHIHCDAALAGMTLPFMDDAPAFDFATGIDSLSISGHKFIGSPIPCGIVLTRKNYVERIARSIEYVGTLDTTITGSRNGITPLFLWYAVKQAGRDGFKRRVAACLDNARYTVEQFKRIGVEARRNPCAITVVFPKPPQSVLHKWQIAVNGDRAHIILMPSTTLQHVDELIADIAAANKAAAAPSDTQKPAAKKRPTPAGAPQRTT

SEQ ID NO: 155 - DNA, 1221 bp, Artificial Sequence
  Variant of Leucine Decarboxylase from Planctomycetaceae bacterium
atgggtaatctgaaatttccagatggcgcgttgagcccgcatgaccgccgccgtctggaagatgtgtatcagtacgttcgtgagcaatgcgacaccttcattgggtatccgtgtacgatgcactttgattacacacctcttttaccgttcctggcctatcccgtcaacaacgtaggcgatccgtttgctgcatccagttatcgcgtgcatacccgtgaaatcgaacgcgaggttctggcgtggttcgccgaactcatgcacattgcaccagaagaatactggggttatgtgactaatggaggaaccgagggcaacctgtacggtttgtttttagcgcgtgaacgctttcctacgggcgtcgcctactattcggaagacacccattatagcgtgtataagaatctgcgtctgctgaacatgcgtcacatcatgatcaaatcacagccgaatggtgagattgattacggcgatctctacgaaactatgcgcattcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgattccttgcggcatcgttttgacacgcaaacattatgtggagcgtattgctcgcagtatcgaatatgtcggtaccctggacactacgattaccggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgcgtcgtaatccatgcgccattaccgttgtgttcccgaaacctccgcagtcagtgctgcacaagtggcaaatcgcagttaacggcgaccgcgcgcatattattttaatgccaagtaccaccctcgagcatgtcgatgaattgatcgctgacattgcagccgccaataaagcggctgcagcaccgagcgatacgcagaaacccgccgccaagaaacgcccgacaccggctggtgcaccgcaacgtactacgtag

SEQ ID NO: 156 - protein, 406 aa, Artificial Sequence
  Variant of Leucine Decarboxylase from Planctomycetaceae bacterium
MGNLKFPDGALSPHDRRRLEDVYQYVREQCDTFIGYPCTMHFDYTPLLPFLAYPVNNVGDPFAASSYRVHTREIEREVLAWFAELMHIAPEEYWGYVTNGGTEGNLYGLFLARERFPTGVAYYSEDTHYSVYKNLRLLNMRHIMIKSQPNGEIDYGDLYETMRIHRDCPPIIFANIGTTMTEGIDNVRTIQDMFKKLAIHESHIHCDAALAGMTLPFMDDAPAFDFATGIDSLSISGHKFIGSPIPCGIVLTRKHYVERIARSIEYVGTLDTTITGSRNGITPLFLWYAVKQAGRDGFKRRVAACLDNARYTVEQFKRIGVEARRNPCAITVVFPKPPQSVLHKWQIAVNGDRAHIILMPSTTLEHVDELIADIAAANKAAAAPSDTQKPAAKKRPTPAGAPQRTT

SEQ ID NO: 157 - DNA, 1221 bp, Artificial Sequence
  Variant of Leucine Decarboxylase from Planctomycetaceae bacterium
atgggtaatctgaaatttccagatggcgcgttgagcccgcatgaccgccgccgtctggaagatgtgtatcagtacgttcgtgagcaatgcgacaccttcattgggtatccgtgtacgatgcactttgattacacacctcttttaccgttcctggcctatcccgtcaacaacgtaggcgatccgtttgctgcatccagttatcgcgtgcatacccgtgaaatcgaacgcgaggttctggcgtggttcgccgaactcatgcacattgcaccagaagaatactggggttatgtgactaatggaggaaccgagggcaacctgtacggtttgtttttagcgcgtgaacgctttcctacgggcgtcgcctactattcggaagacacccattatagcgtgtataagaatctgcgtctgctgaacatgcgtcacatcatgatcaaatcacagccgaatggtgagattgattacggcgatctctacgaaactatgcgcattcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgattccttgcggcatcgttttgacacgcaaacattatgtggagcgtattgctcgcagtatcgaatatgtcggtaccctggacactacgattaccggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgcgtcgtaatccatgcgccattaccgttgtgttcccgaaacctccggattcagtgctgcacaagtggcaaatcgcagttaacggcgaccgcgcgcatattattttaatgccaagtaccaccctccagcatgtcgatgaattgatcgctgacattgcagccgccaataaagcggctgcagcaccgagcgatacgcagaaacccgccgccaagaaacgcccgacaccggctggtgcaccgcaacgtactacgtag

SEQ ID NO: 158 - protein, 406 aa, Artificial Sequence
  Variant of Leucine Decarboxylase from Planctomycetaceae bacterium
MGNLKFPDGALSPHDRRRLEDVYQYVREQCDTFIGYPCTMHFDYTPLLPFLAYPVNNVGDPFAASSYRVHTREIEREVLAWFAELMHIAPEEYWGYVTNGGTEGNLYGLFLARERFPTGVAYYSEDTHYSVYKNLRLLNMRHIMIKSQPNGEIDYGDLYETMRIHRDCPPIIFANIGTTMTEGIDNVRTIQDMFKKLAIHESHIHCDAALAGMTLPFMDDAPAFDFATGIDSLSISGHKFIGSPIPCGIVLTRKHYVERIARSIEYVGTLDTTITGSRNGITPLFLWYAVKQAGRDGFKRRVAACLDNARYTVEQFKRIGVEARRNPCAITVVFPKPPDSVLHKWQIAVNGDRAHIILMPSTTLQHVDELIADIAAANKAAAAPSDTQKPAAKKRPTPAGAPQRTT

SEQ ID NO: 159 - DNA, 1221 bp, Artificial Sequence
  Variant of Leucine Decarboxylase from Planctomycetaceae bacterium
atgggtaatctgaaatttccagatggcgcgttgagcccgcatgaccgccgccgtctggaagatgtgtatcagtacgttcgtgagcaatgcgacaccttcattgggtatccgtgtacgatgcactttgattacacacctcttttaccgttcctggcctatcccgtcaacaacgtaggcgatccgtttgctgcatccagttatcgcgtgcatacccgtgaaatcgaacgcgaggttctggcgtggttcgccgaactcatgcacattgcaccagaagaatactggggttatgtgactaatggaggaaccgagggcaacctgtacggtttgtttttagcgcgtgaacgctttcctacgggcgtcgcctactattcggaagacacccattatagcgtgtataagaatctgcgtctgctgaacatgcgtcacatcatgatcaaatcacagccgaatggtgagattgattacggcgatctctacgaaactatgcgcattcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgattccttgcggcatcgttttgacacgcaaacattatgtggagcgtattgctcgcagtatcgaatatgtcggtaccctggacactacgattaccggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgcgtcgtaatccatgcgccattaccgttgtgttcccgaaacctccgcagtcagtgctgcacaagtggcaaatcgcagttaacggcgaccgcgcgcatattattttaatgccaagtaccaccctccagcatgtcgatgaattgatcgctgacattgcagccgccaataaagcggctgcagcaccgagcgatacgcagaaacccgccgccaagaaacgcccgacaccggctggtgcaccgcaacgtcatacgtag

SEQ ID NO: 160 - protein, 406 aa, Artificial Sequence
  Variant of Leucine Decarboxylase from Planctomycetaceae bacterium
MGNLKFPDGALSPHDRRRLEDVYQYVREQCDTFIGYPCTMHFDYTPLLPFLAYPVNNVGDPFAASSYRVHTREIEREVLAWFAELMHIAPEEYWGYVTNGGTEGNLYGLFLARERFPTGVAYYSEDTHYSVYKNLRLLNMRHIMIKSQPNGEIDYGDLYETMRIHRDCPPIIFANIGTTMTEGIDNVRTIQDMFKKLAIHESHIHCDAALAGMTLPFMDDAPAFDFATGIDSLSISGHKFIGSPIPCGIVLTRKHYVERIARSIEYVGTLDTTITGSRNGITPLFLWYAVKQAGRDGFKRRVAACLDNARYTVEQFKRIGVEARRNPCAITVVFPKPPQSVLHKWQIAVNGDRAHIILMPSTTLQHVDELIADIAAANKAAAAPSDTQKPAAKKRPTPAGAPQRHT

SEQ ID NO: 161 - DNA, 1221 bp, Artificial Sequence
  Variant of Leucine Decarboxylase from Planctomycetaceae bacterium
atgggtaatctgaaatttccagatggcgcgttgagcccgcatgaccgccgccgtctggaagatgtgtatcagtacgttcgtgagcaatgcgacaccttcattgggtatccgtgtacgatgcactttgattacacacctcttttaccgttcctggcctatcccgtcaacaacgtaggcgatccgtttgctgcatccagttatcgcgtgcatacccgtgaaatcgaacgcgaggttctggcgtggttcgccgaactcatgcacattgcaccagaagaatactggggttatgtgactaatggaggaaccgagggcaacctgtacggtttgtttttagcgcgtgaacgctttcctacgggcgtcgcctactattcggaagacacccattatagcgtgtataagaatctgcgtctgctgaacatgcgtcacatcatgatcaaatcacagccgaatggtgagattgattacggcgatctctacgaaactatgcgcattcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgattccttgcggcatcgttttgacacgcaaacattatgtggagcgtattgctcgcagtatcgaatatgtcggtaccctggacactacgattaccggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgcgtcgtaatccatgcgccattaccgttgtgttcccgaaacctccgcagtcagtgctgcacaagtggcaaatcgcagttaacggcgaccgcgcgcatattattttaatgccaagtaccaccctccagcatgtcgatgaattgatcgctgacattgcagccgccaataaagcggatgcagcaccgagcgatacgcagaaacccgccgccaagaaacgcccgacaccggctggtgcaccgcaacgtactacgtag

SEQ ID NO: 162 - protein, 406 aa, Artificial Sequence
  Variant of Leucine Decarboxylase from Planctomycetaceae bacterium
MGNLKFPDGALSPHDRRRLEDVYQYVREQCDTFIGYPCTMHFDYTPLLPFLAYPVNNVGDPFAASSYRVHTREIEREVLAWFAELMHIAPEEYWGYVTNGGTEGNLYGLFLARERFPTGVAYYSEDTHYSVYKNLRLLNMRHIMIKSQPNGEIDYGDLYETMRIHRDCPPIIFANIGTTMTEGIDNVRTIQDMFKKLAIHESHIHCDAALAGMTLPFMDDAPAFDFATGIDSLSISGHKFIGSPIPCGIVLTRKHYVERIARSIEYVGTLDTTITGSRNGITPLFLWYAVKQAGRDGFKRRVAACLDNARYTVEQFKRIGVEARRNPCAITVVFPKPPQSVLHKWQIAVNGDRAHIILMPSTTLQHVDELIADIAAANKADAAPSDTQKPAAKKRPTPAGAPQRTT

SEQ ID NO: 163 - DNA, 1221 bp, Artificial Sequence
  Variant of Leucine Decarboxylase from Planctomycetaceae bacterium
atgggtaatctgaaatttccagatggcgcgttgagcccgcatgaccgccgccgtctggaagatgtgtatcagtacgttcgtgagcaatgcgacaccttcattgggtatccgtgtacgatgcactttgattacacacctcttttaccgttcctggcctatcccgtcaacaacgtaggcgatccgtttgctgcatccagttatcgcgtgcatacccgtgaaatcgaacgcgaggttctggcgtggttcgccgaactcatgcacattgcaccagaagaatactggggttatgtgactaatggaggaaccgagggcaacctgtacggtttgtttttagcgcgtgaacgctttcctacgggcgtcgcctactattcggaagacacccattatagcgtgtataagaatctgcgtctgctgaacatgcgtcacatcatgatcaaatcacagccgaatggtgagattgattacggcgatctctacgaaactatgcgcattcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgattccttgcggcatcgttttgacacgcaaacattatgtggagcgtattgctcgcagtatcgaatatgtcggtaccctggacactacgattaccggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgcgtcgtaatccatgcgccattaccgttgtgttcccgaaacctccgcagtcagtgctgcacaagtggcaaatcgcagttaacggcgaccgcgcgcatatttgtttaatgccaagtaccaccctccagcatgtcgatgaattgatcgctgacattgcagccgccaataaagcggctgcagcaccgagcgatacgcagaaacccgccgccaagaaacgcccgacaccggctggtgcaccgcaacgtactacgtag

SEQ ID NO: 164 - protein, 406 aa, Artificial Sequence
  Variant of Leucine Decarboxylase from Planctomycetaceae bacterium
MGNLKFPDGALSPHDRRRLEDVYQYVREQCDTFIGYPCTMHFDYTPLLPFLAYPVNNVGDPFAASSYRVHTREIEREVLAWFAELMHIAPEEYWGYVTNGGTEGNLYGLFLARERFPTGVAYYSEDTHYSVYKNLRLLNMRHIMIKSQPNGEIDYGDLYETMRIHRDCPPIIFANIGTTMTEGIDNVRTIQDMFKKLAIHESHIHCDAALAGMTLPFMDDAPAFDFATGIDSLSISGHKFIGSPIPCGIVLTRKHYVERIARSIEYVGTLDTTITGSRNGITPLFLWYAVKQAGRDGFKRRVAACLDNARYTVEQFKRIGVEARRNPCAITVVFPKPPQSVLHKWQIAVNGDRAHICLMPSTTLQHVDELIADIAAANKAAAAPSDTQKPAAKKRPTPAGAPQRTT

SEQ ID NO: 165 - DNA, 1221 bp, Artificial Sequence
  Variant of Leucine Decarboxylase from Planctomycetaceae bacterium
atgggtaatctgaaatttccagatggcgcgttgagcccgcatgaccgccgccgtctggaagatgtgtatcagtacgttcgtgagcaatgcgacaccttcattgggtatccgtgtacgatgcactttgattacacacctcttttaccgttcctggcctatcccgtcaacaacgtaggcgatccgtttgctgcatccagttatcgcgtgcatacccgtgaaatcgaacgcgaggttctggcgtggttcgccgaactcatgcacattgcaccagaagaatactggggttatgtgactaatggaggaaccgagggcaacctgtacggtttgtttttagcgcgtgaacgctttcctacgggcgtcgcctactattcggaagacacccattatagcgtgtataagaatctgcgtctgctgaacatgcgtcacatcatgatcaaatcacagccgaatggtgagattgattacggcgatctctacgaaactatgcgcattcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgattccttgcggcatcgttttgacacgcaaacattatgtggagcgtattgctcgcagtatcgaatatgtcggtaccctggacactacgattaccggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgcgtcgtaatccatgcgccattaccgttgtgttcccgaaacctccgcagtcagtgctgcacaagtggcaaatcgcagttaacggcgaccgcgcgcatattattttaatgccaagtaccaccctccagcatgtcgatgaattgatcgctgacattgcagccgccaataaagcggctgcagcaccgagcgatacgcagaaacccgccgccaagaaacgcccgacaccggctggtgcaccgcaacgtgagacgtag

SEQ ID NO: 166 - protein, 406 aa, Artificial Sequence
  Variant of Leucine Decarboxylase from Planctomycetaceae bacterium
MGNLKFPDGALSPHDRRRLEDVYQYVREQCDTFIGYPCTMHFDYTPLLPFLAYPVNNVGDPFAASSYRVHTREIEREVLAWFAELMHIAPEEYWGYVTNGGTEGNLYGLFLARERFPTGVAYYSEDTHYSVYKNLRLLNMRHIMIKSQPNGEIDYGDLYETMRIHRDCPPIIFANIGTTMTEGIDNVRTIQDMFKKLAIHESHIHCDAALAGMTLPFMDDAPAFDFATGIDSLSISGHKFIGSPIPCGIVLTRKHYVERIARSIEYVGTLDTTITGSRNGITPLFLWYAVKQAGRDGFKRRVAACLDNARYTVEQFKRIGVEARRNPCAITVVFPKPPQSVLHKWQIAVNGDRAHIILMPSTTLQHVDELIADIAAANKAAAAPSDTQKPAAKKRPTPAGAPQRET

SEQ ID NO: 167 - DNA, 1221 bp, Artificial Sequence
  Variant of Leucine Decarboxylase from Planctomycetaceae bacterium
atgggtaatctgaaatttccagatggcgcgttgagcccgcatgaccgccgccgtctggaagatgtgtatcagtacgttcgtgagcaatgcgacaccttcattgggtatccgtgtacgatgcactttgattacacacctcttttaccgttcctggcctatcccgtcaacaacgtaggcgatccgtttgctgcatccagttatcgcgtgcatacccgtgaaatcgaacgcgaggttctggcgtggttcgccgaactcatgcacattgcaccagaagaatactggggttatgtgactaatggaggaaccgagggcaacctgtacggtttgtttttagcgcgtgaacgctttcctacgggcgtcgcctactattcggaagacacccattatagcgtgtataagaatctgcgtctgctgaacatgcgtcacatcatgatcaaatcacagccgaatggtgagattgattacggcgatctctacgaaactatgcgcattcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgattccttgcggcatcgttttgacacgcaaacattatgtggagcgtattgctcgcagtatcgaatatgtcggtaccctggacactacgattaccggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgcgtcgtaatccatgcgccattaccgttgtgttcccgaaacctccgcagtcagtgctgcacaagtggcaaatcgcagttaacggcgaccgcgcgcatattattttaatgccaagtaccaccctccagcatgtcgatgaattgatcgctgacattgcagccgccaataaagcggctgcagcaccgagcgatacgcagaaacccgccgccaagaaacgcccgacaccggctggtgcaccgcaacgtgatacgtag

SEQ ID NO: 168 - protein, 406 aa, Artificial Sequence
  Variant of Leucine Decarboxylase from Planctomycetaceae bacterium
MGNLKFPDGALSPHDRRRLEDVYQYVREQCDTFIGYPCTMHFDYTPLLPFLAYPVNNVGDPFAASSYRVHTREIEREVLAWFAELMHIAPEEYWGYVTNGGTEGNLYGLFLARERFPTGVAYYSEDTHYSVYKNLRLLNMRHIMIKSQPNGEIDYGDLYETMRIHRDCPPIIFANIGTTMTEGIDNVRTIQDMFKKLAIHESHIHCDAALAGMTLPFMDDAPAFDFATGIDSLSISGHKFIGSPIPCGIVLTRKHYVERIARSIEYVGTLDTTITGSRNGITPLFLWYAVKQAGRDGFKRRVAACLDNARYTVEQFKRIGVEARRNPCAITVVFPKPPQSVLHKWQIAVNGDRAHIILMPSTTLQHVDELIADIAAANKAAAAPSDTQKPAAKKRPTPAGAPQRDT

SEQ ID NO: 169 - DNA, 1221 bp, Artificial Sequence
  Variant of Leucine Decarboxylase from Planctomycetaceae bacterium
atgggtaatctgaaatttccagatggcgcgttgagcccgcatgaccgccgccgtctggaagatgtgtatcagtacgttcgtgagcaatgcgacaccttcattgggtatccgtgtacgatgcactttgattacacacctcttttaccgttcctggcctatcccgtcaacaacgtaggcgatccgtttgctgcatccagttatcgcgtgcatacccgtgaaatcgaacgcgaggttctggcgtggttcgccgaactcatgcacattgcaccagaagaatactggggttatgtgactaatggaggaaccgagggcaacctgtacggtttgtttttagcgcgtgaacgctttcctacgggcgtcgcctactattcggaagacacccattatagcgtgtataagaatctgcgtctgctgaacatgcgtcacatcatgatcaaatcacagccgaatggtgagattgattacggcgatctctacgaaactatgcgcattcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgattccttgcggcatcgttttgacacgcaaacattatgtggagcgtattgctcgcagtatcgaatatgtcggtaccctggacactacgattaccggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgcgtcgtaatccatgcgccattaccgttgtgttcccgaaacctccgcagtcagtgctgcacaagtggcaaatcgcagttaacggcgactgggcgcatattattttaatgccaagtaccaccctccagcatgtcgatgaattgatcgctgacattgcagccgccaataaagcggctgcagcaccgagcgatacgcagaaacccgccgccaagaaacgcccgacaccggctggtgcaccgcaacgtactacgtag

SEQ ID NO: 170 - protein, 406 aa, Artificial Sequence
  Variant of Leucine Decarboxylase from Planctomycetaceae bacterium
MGNLKFPDGALSPHDRRRLEDVYQYVREQCDTFIGYPCTMHFDYTPLLPFLAYPVNNVGDPFAASSYRVHTREIEREVLAWFAELMHIAPEEYWGYVTNGGTEGNLYGLFLARERFPTGVAYYSEDTHYSVYKNLRLLNMRHIMIKSQPNGEIDYGDLYETMRIHRDCPPIIFANIGTTMTEGIDNVRTIQDMFKKLAIHESHIHCDAALAGMTLPFMDDAPAFDFATGIDSLSISGHKFIGSPIPCGIVLTRKHYVERIARSIEYVGTLDTTITGSRNGITPLFLWYAVKQAGRDGFKRRVAACLDNARYTVEQFKRIGVEARRNPCAITVVFPKPPQSVLHKWQIAVNGDWAHIILMPSTTLQHVDELIADIAAANKAAAAPSDTQKPAAKKRPTPAGAPQRTT

SEQ ID NO: 171 - DNA, 1221 bp, Artificial Sequence
  Variant of Leucine Decarboxylase from Planctomycetaceae bacterium
atgggtaatctgaaatttccagatggcgcgttgagcccgcatgaccgccgccgtctggaagatgtgtatcagtacgttcgtgagcaatgcgacaccttcattgggtatccgtgtacgatgcactttgattacacacctcttttaccgttcctggcctatcccgtcaacaacgtaggcgatccgtttgctgcatccagttatcgcgtgcatacccgtgaaatcgaacgcgaggttctggcgtggttcgccgaactcatgcacattgcaccagaagaatactggggttatgtgactaatggaggaaccgagggcaacttgtacggtttgtttttagcgcgtgaacgctttcctacgggcgtcgcctactattcggaagacacccattatagcgtgtataagaatctgcgtctgctgaacatgcgtcacatcatgatcaaatcacagccgaatggtgagattgattacggcgatctctacgaaactatgcgcattcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgattccttgcggcatcgttttgacacgcaaacattatgtggagcgtattgctcgcagtatcgaatatgtcggtaccctggacactacgattaccggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgactcgtaatccatgcgccattaccgttgtgttcccgaaacctccgcagtcagtgctgcacaagtggcaaatcgcagttaacggcgaccgcgcgcatattattttaatgccaagtaccaccctccagcatgtcgatgaattgatcgctgacattgcagccgccaataaagcggctgcagcaccgagcgatacgcagaaacccgccgccaagaaacgcccgacaccggctggtgcaccgcaacgtactacgtag

SEQ ID NO: 172 - protein, 406 aa, Artificial Sequence
  Variant of Leucine Decarboxylase from Planctomycetaceae bacterium
MGNLKFPDGALSPHDRRRLEDVYQYVREQCDTFIGYPCTMHFDYTPLLPFLAYPVNNVGDPFAASSYRVHTREIEREVLAWFAELMHIAPEEYWGYVTNGGTEGNLYGLFLARERFPTGVAYYSEDTHYSVYKNLRLLNMRHIMIKSQPNGEIDYGDLYETMRIHRDCPPIIFANIGTTMTEGIDNVRTIQDMFKKLAIHESHIHCDAALAGMTLPFMDDAPAFDFATGIDSLSISGHKFIGSPIPCGIVLTRKHYVERIARSIEYVGTLDTTITGSRNGITPLFLWYAVKQAGRDGFKRRVAACLDNARYTVEQFKRIGVEATRNPCAITVVFPKPPQSVLHKWQIAVNGDRAHIILMPSTTLQHVDELIADIAAANKAAAAPSDTQKPAAKKRPTPAGAPQRTT

SEQ ID NO: 173 - DNA, 1221 bp, Artificial Sequence
  Variant of Leucine Decarboxylase from Planctomycetaceae bacterium
atgggtaatctgaaatttccagatggcgcgttgagcccgcatgaccgccgccgtctggaagatgtgtatcagtacgttcgtgagcaatgcgacaccttcattgggtatccgtgtacgatgcactttgattacacacctcttttaccgttcctggcctatcccgtcaacaacgtaggcgatccgtttgctgcatccagttatcgcgtgcatacccgtgaaatcgaacgcgaggttctggcgtggttcgccgaactcatgcacattgcaccagaagaatactggggttatgtgactaatggaggaaccgagggcaacctgtacggtttgtttttagcgcgtgaacgctttcctacgggcgtcgcctactattcggaagacacccattatagcgtgtataagaatctgcgtctgctgaacatgcgtcacatcatgatcaaatcacagccgaatggtgagattgattacggcgatctctacgaaactatgcgcattcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgattccttgcggcatcgttttgacacgcaaacattatgtggagcgtattgctcgcagtatcgaatatgtcggtaccctggacactacgattaccggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgcgtcgtaatccatgcgccattaccgttgtgttcccgaaacctccgcagtcagtgctgcacaagtggcaaatcgcagttaacggcgaccgcgcgcatattattttaatgccaagtaccaccctccagcatgtcgatgaattgatcgctgacattgcagccgccaataaagcggaggcagcaccgagcgatacgcagaaacccgccgccaagaaacgcccgacaccggctggtgcaccgcaacgtactacgtag

SEQ ID NO: 174 - protein, 406 aa, Artificial Sequence
  Variant of Leucine Decarboxylase from Planctomycetaceae bacterium
MGNLKFPDGALSPHDRRRLEDVYQYVREQCDTFIGYPCTMHFDYTPLLPFLAYPVNNVGDPFAASSYRVHTREIEREVLAWFAELMHIAPEEYWGYVTNGGTEGNLYGLFLARERFPTGVAYYSEDTHYSVYKNLRLLNMRHIMIKSQPNGEIDYGDLYETMRIHRDCPPIIFANIGTTMTEGIDNVRTIQDMFKKLAIHESHIHCDAALAGMTLPFMDDAPAFDFATGIDSLSISGHKFIGSPIPCGIVLTRKHYVERIARSIEYVGTLDTTITGSRNGITPLFLWYAVKQAGRDGFKRRVAACLDNARYTVEQFKRIGVEARRNPCAITVVFPKPPQSVLHKWQIAVNGDRAHIILMPSTTLQHVDELIADIAAANKAEAAPSDTQKPAAKKRPTPAGAPQRTT

SEQ ID NO: 175 - DNA, 1221 bp, Artificial Sequence
  Variant of Leucine Decarboxylase from Planctomycetaceae bacterium
atgggtaatctgaaatttccagatggcgcgttgagcccgcatgaccgccgccgtctggaagatgtgtatcagtacgttcgtgagcaatgcgacaccttcattgggtatccgtgtacgatgcactttgattacacacctcttttaccgttcctggcctatcccgtcaacaacgtaggcgatccgtttgctgcatccagttatcgcgtgcatacccgtgaaatcgaacgcgaggttctggcgtggttcgccgaactcatgcacattgcaccagaagaatactggggttatgtgactaatggaggaaccgagggcaacctgtacggtttgtttttagcgcgtgaacgctttcctacgggcgtcgcctactattcggaagacacccattatagcgtgtataagaatctgcgtctgctggggatgcgtcacatcatgatcaaatcacagccgaatggtgagattgattacggcgatctctacgaaactatgcgcattcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgattccttgcggcatcgttttgacacgcaaacattatgtggagcgtattgctcgcagtatcgaatatgtcggtaccctggacactacgattaccggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgcgtcgtaatccatgcgccattaccgttgtgttcccgaaacctccgcagtcagtgctgcacaagtggcaaatcgcagttaacggcgaccgcgcgcatattattttaatgccaagtaccaccctccagcatgtcgatgaattgatcgctgacattgcagccgccaataaagcggctgcagcaccgagcgatacgcagaaacccgccgccaagaaacgcccgacaccggctggtgcaccgcaacgtactacgtag

SEQ ID NO: 176 - protein, 406 aa, Artificial Sequence
  Variant of Leucine Decarboxylase from Planctomycetaceae bacterium
MGNLKFPDGALSPHDRRRLEDVYQYVREQCDTFIGYPCTMHFDYTPLLPFLAYPVNNVGDPFAASSYRVHTREIEREVLAWFAELMHIAPEEYWGYVTNGGTEGNLYGLFLARERFPTGVAYYSEDTHYSVYKNLRLLGMRHIMIKSQPNGEIDYGDLYETMRIHRDCPPIIFANIGTTMTEGIDNVRTIQDMFKKLAIHESHIHCDAALAGMTLPFMDDAPAFDFATGIDSLSISGHKFIGSPIPCGIVLTRKHYVERIARSIEYVGTLDTTITGSRNGITPLFLWYAVKQAGRDGFKRRVAACLDNARYTVEQFKRIGVEARRNPCAITVVFPKPPQSVLHKWQIAVNGDRAHIILMPSTTLQHVDELIADIAAANKAAAAPSDTQKPAAKKRPTPAGAPQRTT

SEQ ID NO: 177 - DNA, 1221 bp, Artificial Sequence
  Variant of Leucine Decarboxylase from Planctomycetaceae bacterium
atgggtaatctgaaatttccagatggcgcgttgagcccgcatgaccgccgccgtctggaagatgtgtatcagtacgttcgtgagcaatgcgacaccttcattgggtatccgtgtacgatgcactttgattacacacctcttttaccgttcctggcctatcccgtcaacaacgtaggcgatccgtttgctgcatccagttatcgcgtgcatacccgtgaaatcgaacgcgaggttctggcgtggttcgccgaactcatgcacattgcaccagaagaatactggggttatgtgactaatggaggaaccgagggcaacctgtacggtttgtttttagcgcgtgaacgctttcctacgggcgtcgcctactattcggaagacacccattatagcgtgtataagaatctgcgtctgctgaacatgcgtcacatcatgatcaaatcacagccgaatggtgagattgattacggcgatctctacgaaactatgcgcattcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgattccttgcggcatcgttttgacacgcaaacattatgtggagcgtattgctcgcagtatcgaatatgtcggtaccctggacactacgattaccggcagccgtaatggtattacaccgctgtttctttggtacgcggtgaaacaagctggacgcgatggcttcgttcgtcgtgttgcggcatgtctggataacgcccgctatacggtcgagcagtttaaacgcatcggtgtagaagcgcgtcgtaatccatgcgccattaccgttgtgttcccgaaacctccgcagtcagtgctgcacaagtggcaaatcgcagttaacggcgaccgcgcgcatattattttaatgccaagtaccaccctccagcatgtcgatgaattgatcgctgacattgcagccgccaataaagcggctgcagcaccgagcgatacgcagaaacccgccgccaagaaacgcccgacaccggctggtgcaccgcaacgtactacgtag

SEQ ID NO: 178 - protein, 406 aa, Artificial Sequence
  Variant of Leucine Decarboxylase from Planctomycetaceae bacterium
MGNLKFPDGALSPHDRRRLEDVYQYVREQCDTFIGYPCTMHFDYTPLLPFLAYPVNNVGDPFAASSYRVHTREIEREVLAWFAELMHIAPEEYWGYVTNGGTEGNLYGLFLARERFPTGVAYYSEDTHYSVYKNLRLLNMRHIMIKSQPNGEIDYGDLYETMRIHRDCPPIIFANIGTTMTEGIDNVRTIQDMFKKLAIHESHIHCDAALAGMTLPFMDDAPAFDFATGIDSLSISGHKFIGSPIPCGIVLTRKHYVERIARSIEYVGTLDTTITGSRNGITPLFLWYAVKQAGRDGFVRRVAACLDNARYTVEQFKRIGVEARRNPCAITVVFPKPPQSVLHKWQIAVNGDRAHIILMPSTTLQHVDELIADIAAANKAAAAPSDTQKPAAKKRPTPAGAPQRTT

SEQ ID NO: 179 - DNA, 1221 bp, Artificial Sequence
  Variant of Leucine Decarboxylase from Planctomycetaceae bacterium
atgggtaatctgaaatttccagatggcgcgttgagcccgcatgaccgccgccgtctggaagatgtgtatcagtacgttcgtgagcaatgcgacaccttcattgggtatccgtgtacgatgcactttgattacacacctcttttaccgttcctggcctatcccgtcaacaacgtaggcgatccgtttgctgcatccagttatcgcgtgcatacccgtgaaatcgaacgcgaggttctggcgtggttcgccgaactcatgcacattgcaccagaagaatactggggttatgtgactaatggaggaaccgagggcaacctgtacggtttgtttttagcgcgtgaacgctttcctacgggcgtcgcctactattcggaagacacccattatagcgtgtataagaatctgcgtctgctgaacatgcgtcacatcatgatcaaatcacagccgaatggtgagattgattacggcgatctctacgaaactatgcgcattcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgattccttgcggcatcgttttgacacgcaaacattatgtggagcgtattgctcgcagtatcgaatatgtcggtaccctggacactacgattaccggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgcgtcgtaatccatgcgccattaccgttgtgttcccgaaacctccgcagtcagtgctgcacaagtggcaaatcgcagttaacggcgaccgcgcgcatattattttaatgccaagtaccaccctccagcatgtcgatgaattgatcgctgacattgcagccgccaatccggcggctgcagcaccgagcgatacgcagaaacccgccgccaagaaacgcccgacaccggctggtgcaccgcaacgtactacgtag

SEQ ID NO: 180 - protein, 406 aa, Artificial Sequence
  Variant of Leucine Decarboxylase from Planctomycetaceae bacterium
MGNLKFPDGALSPHDRRRLEDVYQYVREQCDTFIGYPCTMHFDYTPLLPFLAYPVNNVGDPFAASSYRVHTREIEREVLAWFAELMHIAPEEYWGYVTNGGTEGNLYGLFLARERFPTGVAYYSEDTHYSVYKNLRLLNMRHIMIKSQPNGEIDYGDLYETMRIHRDCPPIIFANIGTTMTEGIDNVRTIQDMFKKLAIHESHIHCDAALAGMTLPFMDDAPAFDFATGIDSLSISGHKFIGSPIPCGIVLTRKHYVERIARSIEYVGTLDTTITGSRNGITPLFLWYAVKQAGRDGFKRRVAACLDNARYTVEQFKRIGVEARRNPCAITVVFPKPPQSVLHKWQIAVNGDRAHIILMPSTTLQHVDELIADIAAANPAAAAPSDTQKPAAKKRPTPAGAPQRTT

SEQ ID NO: 181 - DNA, 1221 bp, Artificial Sequence
  Variant of Leucine Decarboxylase from Planctomycetaceae bacterium
atgggtaatctgaaatttccagatggcgcgttgagcccgcatgaccgccgccgtctggaagatgtgtatcagtacgttcgtgagcaatgcgacaccttcattgggtatccgtgtacgatgcactttgattacacacctcttttaccgttcctggcctatcccgtcaacaacgtaggcgatccgtttgctgcatccagttatcgcgtgcatacccgtgaaatcgaacgcgaggttctggcgtggttcgccgaactcatgcacattgcaccagaagaatactggggttatgtgactaatggaggaaccgagggcaacctgtacggtttgtttttagcgcgtgaacgctttcctacgggcgtcgcctactattcggaagacacccattatagcgtgtataagaatctgcgtctgctgaacatgcgtcacatcatgatcaaatcacagccgaatggtgagattgattacggcgatctctacgaaactatgcgcattcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgattccttgcggcatcgttttgacacgcaaacattatgtggagcgtattgctcgcagtatcgaatatgtcggtaccctggacactacgattaccggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgcgtcgtaatccatgcgccattaccgttgtgttcccgaaacctccggcgtcagtgctgcacaagtggcaaatcgcagttaacggcgaccgcgcgcatattattttaatgccaagtaccaccctccagcatgtcgatgaattgatcgctgacattgcagccgccaataaagcggctgcagcaccgagcgatacgcagaaacccgccgccaagaaacgcccgacaccggctggtgcaccgcaacgtactacgtag

SEQ ID NO: 182 - protein, 406 aa, Artificial Sequence
  Variant of Leucine Decarboxylase from Planctomycetaceae bacterium
MGNLKFPDGALSPHDRRRLEDVYQYVREQCDTFIGYPCTMHFDYTPLLPFLAYPVNNVGDPFAASSYRVHTREIEREVLAWFAELMHIAPEEYWGYVTNGGTEGNLYGLFLARERFPTGVAYYSEDTHYSVYKNLRLLNMRHIMIKSQPNGEIDYGDLYETMRIHRDCPPIIFANIGTTMTEGIDNVRTIQDMFKKLAIHESHIHCDAALAGMTLPFMDDAPAFDFATGIDSLSISGHKFIGSPIPCGIVLTRKHYVERIARSIEYVGTLDTTITGSRNGITPLFLWYAVKQAGRDGFKRRVAACLDNARYTVEQFKRIGVEARRNPCAITVVFPKPPASVLHKWQIAVNGDRAHIILMPSTTLQHVDELIADIAAANKAAAAPSDTQKPAAKKRPTPAGAPQRTT

SEQ ID NO: 183 - DNA, 1221 bp, Artificial Sequence
  Variant of Leucine Decarboxylase from Planctomycetaceae bacterium
atgggtaatctgaaatttccagatggcgcgttgagcccgcatgaccgccgccgtctggaagatgtgtatcagtacgttcgtgagcaatgcgacaccttcattgggtatccgtgtacgatgcactttgattacacacctcttttaccgttcctggcctatcccgtcaacaacgtaggcgatccgtttgctgcatccagttatcgcgtgcatacccgtgaaatcgaacgcgaggttctggcgtggttcgccgaactcatgcacattgcaccagaagaatactggggttatgtgactaatggaggaaccgagggcaacctgtacggtttgtttttagcgcgtgaacgctttcctacgggcgtcgcctactattcggaagacacccattatagcgtgtataagaatctgcgtctgctgaacatgcgtcacatcatgatcaaatcacagccgaatggtgagattgattacggcgatctctacgaaactatgcgcattcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgattccttgcggcatcgttttgacacgcaaacattatgtggagcgtattgctcgcagtatcgaatatgtcggtaccctggacactacgattaccggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgagtcgtaatccatgcgccattaccgttgtgttcccgaaacctccgcagtcagtgctgcacaagtggcaaatcgcagttaacggcgaccgcgcgcatattattttaatgccaagtaccaccctccagcatgtcgatgaattgatcgctgacattgcagccgccaataaagcggctgcagcaccgagcgatacgcagaaacccgccgccaagaaacgcccgacaccggctggtgcaccgcaacgtactacgtag

SEQ ID NO: 184 - protein, 406 aa, Artificial Sequence
  Variant of Leucine Decarboxylase from Planctomycetaceae bacterium
MGNLKFPDGALSPHDRRRLEDVYQYVREQCDTFIGYPCTMHFDYTPLLPFLAYPVNNVGDPFAASSYRVHTREIEREVLAWFAELMHIAPEEYWGYVTNGGTEGNLYGLFLARERFPTGVAYYSEDTHYSVYKNLRLLNMRHIMIKSQPNGEIDYGDLYETMRIHRDCPPIIFANIGTTMTEGIDNVRTIQDMFKKLAIHESHIHCDAALAGMTLPFMDDAPAFDFATGIDSLSISGHKFIGSPIPCGIVLTRKHYVERIARSIEYVGTLDTTITGSRNGITPLFLWYAVKQAGRDGFKRRVAACLDNARYTVEQFKRIGVEASRNPCAITVVFPKPPQSVLHKWQIAVNGDRAHIILMPSTTLQHVDELIADIAAANKAAAAPSDTQKPAAKKRPTPAGAPQRTT

SEQ ID NO: 185 - DNA, 1221 bp, Artificial Sequence
  Variant of Leucine Decarboxylase from Planctomycetaceae bacterium
atgggtaatctgaaatttccagatggcgcgttgagcccgcatgaccgccgccgtctggaagatgtgtatcagtacgttcgtgagcaatgcgacaccttcattgggtatccgtgtacgatgcactttgattacacacctcttttaccgttcctggcctatcccgtcaacaacgtaggcgatccgtttgctgcatccagttatcgcgtgcatacccgtgaaatcgaacgcgaggttctggcgtggttcgccgaactcatgcacattgcaccagaagaatactggggttatgtgactaatggaggaaccgagggcaacctgtacggtttgtttttagcgcgtgaacgctttcctacgggcgtcgcctactattcggaagacacccattatagcgtgtataagaatctgcgtctgctgaacatgcgtcacatcatgatcaaatcacagccgaatggtgagattgattacggcgatctctacgaaactatgcgcattcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgattccttgcggcatcgttttgacacgcaaacattatgtggagcgtattgctcgcagtatcgaatatgtcggtaccctggacactacgattaccggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgcgtcgtaatccatgcgccattaccgttgtgttcccgaaacctccgcagtcagtgctgcacaagtggcaaatcgcagttaacggcgacgatgcgcatattattttaatgccaagtaccaccctccagcatgtcgatgaattgatcgctgacattgcagccgccaataaagcggctgcagcaccgagcgatacgcagaaacccgccgccaagaaacgcccgacaccggctggtgcaccgcaacgtactacgtag

SEQ ID NO: 186 - protein, 406 aa, Artificial Sequence
  Variant of Leucine Decarboxylase from Planctomycetaceae bacterium
MGNLKFPDGALSPHDRRRLEDVYQYVREQCDTFIGYPCTMHFDYTPLLPFLAYPVNNVGDPFAASSYRVHTREIEREVLAWFAELMHIAPEEYWGYVTNGGTEGNLYGLFLARERFPTGVAYYSEDTHYSVYKNLRLLNMRHIMIKSQPNGEIDYGDLYETMRIHRDCPPIIFANIGTTMTEGIDNVRTIQDMFKKLAIHESHIHCDAALAGMTLPFMDDAPAFDFATGIDSLSISGHKFIGSPIPCGIVLTRKHYVERIARSIEYVGTLDTTITGSRNGITPLFLWYAVKQAGRDGFKRRVAACLDNARYTVEQFKRIGVEARRNPCAITVVFPKPPQSVLHKWQIAVNGDDAHIILMPSTTLQHVDELIADIAAANKAAAAPSDTQKPAAKKRPTPAGAPQRTT

SEQ ID NO: 187 - DNA, 1221 bp, Artificial Sequence
  Variant of Leucine Decarboxylase from Planctomycetaceae bacterium
atgggtaatctgaaatttccagatggcgcgttgagcccgcatgaccgccgccgtctggaagatgtgtatcagtacgttcgtgagcaatgcgacaccttcattgggtatccgtgtacgatgcactttgattacacacctcttttaccgttcctggcctatcccgtcaacaacgtaggcgatccgtttgctgcatccagttatcgcgtgcatacccgtgaaatcgaacgcgaggttctggcgtggttcgccgaactcatgcacattgcaccagaagaatactggggttatgtgactaatggaggaaccgagggcaacctgtacggtttgtttttagcgcgtgaacgctttcctacgggcgtcgcctactattcggaagacacccattatagcgtgtataagaatctgcgtctgctgaacatgcgtcacatcatgatcaaatcacagccgaatggtgagattgattacggcgatctctacgaaactatgcgcattcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgattccttgcggcatcgttttgacacgcaaacattatgtggagcgtattgctcgcagtatcgaatatgtcggtaccctggacactacgattaccggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgcgtcgtaatccatgcgccattaccgttgtgttcccgaaacctccgcagtcagtgctgcacaagtggcaaatcgcagttaacggcgaccgcgcgcatattattttaatgccaagtaccaccaagcagcatgtcgatgaattgatcgctgacattgcagccgccaataaagcggctgcagcaccgagcgatacgcagaaacccgccgccaagaaacgcccgacaccggctggtgcaccgcaacgtactacgtag

SEQ ID NO: 188 - protein, 406 aa, Artificial Sequence
  Variant of Leucine Decarboxylase from Planctomycetaceae bacterium
MGNLKFPDGALSPHDRRRLEDVYQYVREQCDTFIGYPCTMHFDYTPLLPFLAYPVNNVGDPFAASSYRVHTREIEREVLAWFAELMHIAPEEYWGYVTNGGTEGNLYGLFLARERFPTGVAYYSEDTHYSVYKNLRLLNMRHIMIKSQPNGEIDYGDLYETMRIHRDCPPIIFANIGTTMTEGIDNVRTIQDMFKKLAIHESHIHCDAALAGMTLPFMDDAPAFDFATGIDSLSISGHKFIGSPIPCGIVLTRKHYVERIARSIEYVGTLDTTITGSRNGITPLFLWYAVKQAGRDGFKRRVAACLDNARYTVEQFKRIGVEARRNPCAITVVFPKPPQSVLHKWQIAVNGDRAHIILMPSTTKQHVDELIADIAAANKAAAAPSDTQKPAAKKRPTPAGAPQRTT

SEQ ID NO: 189 - DNA, 1221 bp, Artificial Sequence
  Variant of Leucine Decarboxylase from Planctomycetaceae bacterium
atgggtaatctgaaatttccagatggcgcgttgagcccgcatgaccgccgccgtctggaagatgtgtatcagtacgttcgtgagcaatgcgacaccttcattgggtatccgtgtacgatgcactttgattacacacctcttttaccgttcctggcctatcccgtcaacaacgtaggcgatccgtttgctgcatccagttatcgcgtgcatacccgtgaaatcgaacgcgaggttctggcgtggttcgccgaactcatgcacattgcaccagaagaatactggggttatgtgactaatggaggaaccgagggcaacctgtacggtttgtttttagcgcgtgaacgctttcctacgggcgtcgcctactattcggaagacacccattatagcgtgtataagaatctgcgtctgctgaacatgcgtcacatcatgatcaaatcacagccgaatggtgagattgattacggcgatctctacgaaactatgcgcattcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgattccttgcggcatcgttttgacacgcaaacattatgtggagcgtattgctcgcagtatcgaatatgtcggtaccctggacactacgattaccggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgcgtcgtaatccatgcgccattaccgttgtgttcccgaaacctccgcagtcagtgctgcacaagtggcaaatcgcagttaacggcgaccgcgcgcatattattttaatgccaagtaccaccctccagcatgtcgatgaattgatcgctgacattgcagccgccaataaagcggctgcagcaccgagcgatacgcagaaacccgccgccaagaaaggtccgacaccggctggtgcaccgcaacgtactacgtag

SEQ ID NO: 190 - protein, 406 aa, Artificial Sequence
  Variant of Leucine Decarboxylase from Planctomycetaceae bacterium
MGNLKFPDGALSPHDRRRLEDVYQYVREQCDTFIGYPCTMHFDYTPLLPFLAYPVNNVGDPFAASSYRVHTREIEREVLAWFAELMHIAPEEYWGYVTNGGTEGNLYGLFLARERFPTGVAYYSEDTHYSVYKNLRLLNMRHIMIKSQPNGEIDYGDLYETMRIHRDCPPIIFANIGTTMTEGIDNVRTIQDMFKKLAIHESHIHCDAALAGMTLPFMDDAPAFDFATGIDSLSISGHKFIGSPIPCGIVLTRKHYVERIARSIEYVGTLDTTITGSRNGITPLFLWYAVKQAGRDGFKRRVAACLDNARYTVEQFKRIGVEARRNPCAITVVFPKPPQSVLHKWQIAVNGDRAHIILMPSTTLQHVDELIADIAAANKAAAAPSDTQKPAAKKGPTPAGAPQRTT

SEQ ID NO: 191 - DNA, 1221 bp, Artificial Sequence
  Variant of Leucine Decarboxylase from Planctomycetaceae bacterium
atgggtaatctgaaatttccagatggcgcgttgagcccgcatgaccgccgccgtctggaagatgtgtatcagtacgttcgtgagcaatgcgacaccttcattgggtatccgtgtacgatgcactttgattacacacctcttttaccgttcctggcctatcccgtcaacaacgtaggcgatccgtttgctgcatccagttatcgcgtgcatacccgtgaaatcgaacgcgaggttctggcgtggttcgccgaactcatgcacattgcaccagaagaatactggggttatgtgactaatggaggaaccgagggcaacctgtacggtttgtttttagcgcgtgaacgctttcctacgggcgtcgcctactattcggaagacacccattatagcgtgtataagaatctgcgtctgctgaacatgcgtcacatcatgatcaaatcacagccgaatggtgagattgattacggcgatctctacgaaactatgcgcattcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgattccttgcggcatcgttttgacacgcaaacattatgtggagcgtattgctcgcagtatcgaatatgtcggtaccctggacactacgattaccggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgcgtcgtaatccatgcgccattaccgttgtgttcccgaaacctccgcagtcagtgctgcacaagtggcaaatcgcagttaacggcgacagtgcgcatattattttaatgccaagtaccaccctccagcatgtcgatgaattgatcgctgacattgcagccgccaataaagcggctgcagcaccgagcgatacgcagaaacccgccgccaagaaacgcccgacaccggctggtgcaccgcaacgtactacgtag

SEQ ID NO: 192 - protein, 406 aa, Artificial Sequence
  Variant of Leucine Decarboxylase from Planctomycetaceae bacterium
MGNLKFPDGALSPHDRRRLEDVYQYVREQCDTFIGYPCTMHFDYTPLLPFLAYPVNNVGDPFAASSYRVHTREIEREVLAWFAELMHIAPEEYWGYVTNGGTEGNLYGLFLARERFPTGVAYYSEDTHYSVYKNLRLLNMRHIMIKSQPNGEIDYGDLYETMRIHRDCPPIIFANIGTTMTEGIDNVRTIQDMFKKLAIHESHIHCDAALAGMTLPFMDDAPAFDFATGIDSLSISGHKFIGSPIPCGIVLTRKHYVERIARSIEYVGTLDTTITGSRNGITPLFLWYAVKQAGRDGFKRRVAACLDNARYTVEQFKRIGVEARRNPCAITVVFPKPPQSVLHKWQIAVNGDSAHIILMPSTTLQHVDELIADIAAANKAAAAPSDTQKPAAKKRPTPAGAPQRTT

SEQ ID NO: 193 - DNA, 1221 bp, Artificial Sequence
  Variant of Leucine Decarboxylase from Planctomycetaceae bacterium
atgggtaatctgaaatttccagatggcgcgttgagcccgcatgaccgccgccgtctggaagatgtgtatcagtacgttcgtgagcaatgcgacaccttcattgggtatccgtgtacgatgcactttgattacacacctcttttaccgttcctggcctatcccgtcaacaacgtaggcgatccgtttgctgcatccagttatcgcgtgcatacccgtgaaatcgaacgcgaggttctggcgtggttcgccgaactcatgcacattgcaccagaagaatactggggttatgtgactaatggaggaaccgagggcaacctgtacggtttgtttttagcgcgtgaacgctttcctacgggcgtcgcctactattcggaagacacccattatagcgtgtataagaatctgcgtctgctgaacatgcgtcacatcatgatcaaatcacagccgaatggtgagattgattacggcgatctctacgaaactatgcgcattcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgattccttgcggcatcgttttgacacgcaaacattatgtggagcgtattgctcgcagtatcgaatatgtcggtaccctggacactacgattaccggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgcgtcgtaatccatgcgccattaccgttgtgttcccgaaacctccgcagtcagtgctgcacaagtggcaaatcgcagttaacggcgaccgcgcgcatattattttaatgccaagtaccaccctccagcatgtcgatgaattgatcgctgacattgcagccgccaataaagcggctgcagcaccgagcgatacgcagaaacccgccgccaagaaaagtccgacaccggctggtgcaccgcaacgtactacgtag

SEQ ID NO: 194 - protein, 406 aa, Artificial Sequence
  Variant of Leucine Decarboxylase from Planctomycetaceae bacterium
MGNLKFPDGALSPHDRRRLEDVYQYVREQCDTFIGYPCTMHFDYTPLLPFLAYPVNNVGDPFAASSYRVHTREIEREVLAWFAELMHIAPEEYWGYVTNGGTEGNLYGLFLARERFPTGVAYYSEDTHYSVYKNLRLLNMRHIMIKSQPNGEIDYGDLYETMRIHRDCPPIIFANIGTTMTEGIDNVRTIQDMFKKLAIHESHIHCDAALAGMTLPFMDDAPAFDFATGIDSLSISGHKFIGSPIPCGIVLTRKHYVERIARSIEYVGTLDTTITGSRNGITPLFLWYAVKQAGRDGFKRRVAACLDNARYTVEQFKRIGVEARRNPCAITVVFPKPPQSVLHKWQIAVNGDRAHIILMPSTTLQHVDELIADIAAANKAAAAPSDTQKPAAKKSPTPAGAPQRTT

SEQ ID NO: 195 - DNA, 1221 bp, Artificial Sequence
  Variant of Leucine Decarboxylase from Planctomycetaceae bacterium
atgggtaatctgaaatttccagatggcgcgttgagcccgcatgaccgccgccgtctggaagatgtgtatcagtacgttcgtgagcaatgcgacaccttcattgggtatccgtgtacgatgcactttgattacacacctcttttaccgttcctggcctatcccgtcaacaacgtaggcgatccgtttgctgcatccagttatcgcgtgcatacccgtgaaatcgaacgcgaggttctggcgtggttcgccgaactcatgcacattgcaccagaagaatactggggttatgtgactaatggaggaaccgagggcaacctgtacggtttgtttttagcgcgtgaacgctttcctacgggcgtcgcctactattcggaagacacccattatagcgtgtataagaatctgcgtctgctgaacatgcgtcacatcatgatcaaatcacagccgaatggtgagattgattacggcgatctctacgaaactatgcgcattcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgattccttgcggcatcgttttgacacgcaaacattatgtggagcgtattgctcgcagtatcgaatatgtcggtaccctggacactacgattaccggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgcgtcgtaatccatgcgccattaccgttgtgttcccgaaacctccgcagtcagtgctgcacaagtggcaaatcgcagttaacggcgaccgcgcgcatattatgttaatgccaagtaccaccctccagcatgtcgatgaattgatcgctgacattgcagccgccaataaagcggctgcagcaccgagcgatacgcagaaacccgccgccaagaaacgcccgacaccggctggtgcaccgcaacgtactacgtag

SEQ ID NO: 196 - protein, 406 aa, Artificial Sequence
  Variant of Leucine Decarboxylase from Planctomycetaceae bacterium
MGNLKFPDGALSPHDRRRLEDVYQYVREQCDTFIGYPCTMHFDYTPLLPFLAYPVNNVGDPFAASSYRVHTREIEREVLAWFAELMHIAPEEYWGYVTNGGTEGNLYGLFLARERFPTGVAYYSEDTHYSVYKNLRLLNMRHIMIKSQPNGEIDYGDLYETMRIHRDCPPIIFANIGTTMTEGIDNVRTIQDMFKKLAIHESHIHCDAALAGMTLPFMDDAPAFDFATGIDSLSISGHKFIGSPIPCGIVLTRKHYVERIARSIEYVGTLDTTITGSRNGITPLFLWYAVKQAGRDGFKRRVAACLDNARYTVEQFKRIGVEARRNPCAITVVFPKPPQSVLHKWQIAVNGDRAHIMLMPSTTLQHVDELIADIAAANKAAAAPSDTQKPAAKKRPTPAGAPQRTT

SEQ ID NO: 197 - DNA, 1221 bp, Artificial Sequence
  Variant of Leucine Decarboxylase from Planctomycetaceae bacterium
atgggtaatctgaaatttccagatggcgcgttgagcccgcatgaccgccgccgtctggaagatgtgtatcagtacgttcgtgagcaatgcgacaccttcattgggtatccgtgtacgatgcactttgattacacacctcttttaccgttcctggcctatcccgtcaacaacgtaggcgatccgtttgctgcatccagttatcgcgtgcatacccgtgaaatcgaacgcgaggttctggcgtggttcgccgaactcatgcacattgcaccagaagaatactggggttatgtgactaatggaggaaccgagggcaacctgtacggtttgtttttagcgcgtgaacgctttcctacgggcgtcgcctactattcggaagacacccattatagcgtgtataagaatctgcgtctgctgaacatgcgtcacatcatgatcaaatcacagccgaatggtgagattgattacggcgatctctacgaaactatgcgcattcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgattccttgcggcatcgttttgacacgcaaacattatgtggagcgtattgctcgcagtatcgaatatgtcggtaccctggacactacgattaccggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgcgtcgtaatccatgcgccattaccgttgtgttcccgaaacctccgcagtcagtgctgcacaagtggcaaatcgcagttaacggcgaccgcgcgcatattattttaatgccaagtaccaccctccagcatgtcgatgaattgatcgctgacattgcagccgccaataaagcggctgcagcaccgagctagacgcagaaacccgccgccaagaaacgcccgacaccggctggtgcaccgcaacgtactacgtag

SEQ ID NO: 198 - protein, 385 aa, Artificial Sequence
  Variant of Leucine Decarboxylase from Planctomycetaceae bacterium
MGNLKFPDGALSPHDRRRLEDVYQYVREQCDTFIGYPCTMHFDYTPLLPFLAYPVNNVGDPFAASSYRVHTREIEREVLAWFAELMHIAPEEYWGYVTNGGTEGNLYGLFLARERFPTGVAYYSEDTHYSVYKNLRLLNMRHIMIKSQPNGEIDYGDLYETMRIHRDCPPIIFANIGTTMTEGIDNVRTIQDMFKKLAIHESHIHCDAALAGMTLPFMDDAPAFDFATGIDSLSISGHKFIGSPIPCGIVLTRKHYVERIARSIEYVGTLDTTITGSRNGITPLFLWYAVKQAGRDGFKRRVAACLDNARYTVEQFKRIGVEARRNPCAITVVFPKPPQSVLHKWQIAVNGDRAHIILMPSTTLQHVDELIADIAAANKAAAAPS

SEQ ID NO: 199 - DNA, 1221 bp, Artificial Sequence
  Variant of Leucine Decarboxylase from Planctomycetaceae bacterium
atgggtaatctgaaatttccagatggcgcgttgagcccgcatgaccgccgccgtctggaagatgtgtatcagtacgttcgtgagcaatgcgacaccttcattgggtatccgtgtacgatgcactttgattacacacctcttttaccgttcctggcctatcccgtcaacaacgtaggcgatccgtttgctgcatccagttatcgcgtgcatacccgtgaaatcgaacgcgaggttctggcgtggttcgccgaactcatgcacattgcaccagaagaatactggggttatgtgactaatggaggaaccgagggcaacctgtacggtttgtttttagcgcgtgaacgctttcctacgggcgtcgcctactattcggaagacacccattatagcgtgtataagaatctgcgtctgctgaacatgcgtcacatcatgatcaaatcacagccgaatggtgagattgattacggcgatctctacgaaactatgcgcattcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgattccttgcggcatcgttttgacacgcaaacattatgtggagcgtattgctcgcagtatcgaatatgtcggtaccctggacactacgattaccggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgcgtcgtaatccatgcgccattaccgttgtgttcccgaaacctccgcagtcagtgctgcacaagtggcaaatcgcagttaacggcgacaatgcgcatattattttaatgccaagtaccaccctccagcatgtcgatgaattgatcgctgacattgcagccgccaataaagcggctgcagcaccgagcgatacgcagaaacccgccgccaagaaacgcccgacaccggctggtgcaccgcaacgtactacgtag

SEQ ID NO: 200 - protein, 406 aa, Artificial Sequence
  Variant of Leucine Decarboxylase from Planctomycetaceae bacterium
MGNLKFPDGALSPHDRRRLEDVYQYVREQCDTFIGYPCTMHFDYTPLLPFLAYPVNNVGDPFAASSYRVHTREIEREVLAWFAELMHIAPEEYWGYVTNGGTEGNLYGLFLARERFPTGVAYYSEDTHYSVYKNLRLLNMRHIMIKSQPNGEIDYGDLYETMRIHRDCPPIIFANIGTTMTEGIDNVRTIQDMFKKLAIHESHIHCDAALAGMTLPFMDDAPAFDFATGIDSLSISGHKFIGSPIPCGIVLTRKHYVERIARSIEYVGTLDTTITGSRNGITPLFLWYAVKQAGRDGFKRRVAACLDNARYTVEQFKRIGVEARRNPCAITVVFPKPPQSVLHKWQIAVNGDNAHIILMPSTTLQHVDELIADIAAANKAAAAPSDTQKPAAKKRPTPAGAPQRTT

SEQ ID NO: 201 - DNA, 1221 bp, Artificial Sequence
  Variant of Leucine Decarboxylase from Planctomycetaceae bacterium
atgggtaatctgaaatttccagatggcgcgttgagcccgcatgaccgccgccgtctggaagatgtgtatcagtacgttcgtgagcaatgcgacaccttcattgggtatccgtgtacgatgcactttgattacacacctcttttaccgttcctggcctatcccgtcaacaacgtaggcgatccgtttgctgcatccagttatcgcgtgcatacccgtgaaatcgaacgcgaggttctggcgtggttcgccgaactcatgcacattgcaccagaagaatactggggttatgtgactaatggaggaaccgagggcaacctgtacggtttgtttttagcgcgtgaacgctttcctacgggcgtcgcctactattcggaagacacccattatagcgtgtataagaatctgcgtctgctgaacatgcgtcacatcatgatcaaatcacagccgaatggtgagattgattacggcgatctctacgaaactatgcgcattcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgattccttgcggcatcgttttgacacgcaaacattatgtggagcgtattgctcgcagtatcgaatatgtcggtaccctggacactacgattaccggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgcgtcgtaatccatgcgccattaccgttgtgttcccgaaacctccgcagtcagtgctgcacaagtggcaaatcgcagttaacggcgaccttgcgcatattattttaatgccaagtaccaccctccagcatgtcgatgaattgatcgctgacattgcagccgccaataaagcggctgcagcaccgagcgatacgcagaaacccgccgccaagaaacgcccgacaccggctggtgcaccgcaacgtactacgtag

SEQ ID NO: 202 - protein, 406 aa, Artificial Sequence
  Variant of Leucine Decarboxylase from Planctomycetaceae bacterium
MGNLKFPDGALSPHDRRRLEDVYQYVREQCDTFIGYPCTMHFDYTPLLPFLAYPVNNVGDPFAASSYRVHTREIEREVLAWFAELMHIAPEEYWGYVTNGGTEGNLYGLFLARERFPTGVAYYSEDTHYSVYKNLRLLNMRHIMIKSQPNGEIDYGDLYETMRIHRDCPPIIFANIGTTMTEGIDNVRTIQDMFKKLAIHESHIHCDAALAGMTLPFMDDAPAFDFATGIDSLSISGHKFIGSPIPCGIVLTRKHYVERIARSIEYVGTLDTTITGSRNGITPLFLWYAVKQAGRDGFKRRVAACLDNARYTVEQFKRIGVEARRNPCAITVVFPKPPQSVLHKWQIAVNGDLAHIILMPSTTLQHVDELIADIAAANKAAAAPSDTQKPAAKKRPTPAGAPQRTT

SEQ ID NO: 203 - DNA, 1221 bp, Artificial Sequence
  Variant of Leucine Decarboxylase from Planctomycetaceae bacterium
atgggtaatctgaaatttccagatggcgcgttgagcccgcatgaccgccgccgtctggaagatgtgtatcagtacgttcgtgagcaatgcgacaccttcattgggtatccgtgtacgatgcactttgattacacacctcttttaccgttcctggcctatcccgtcaacaacgtaggcgatccgtttgctgcatccagttatcgcgtgcatacccgtgaaatcgaacgcgaggttctggcgtggttcgccgaactcatgcacattgcaccagaagaatactggggttatgtgactaatggaggaaccgagggcaacctgtacggtttgtttttagcgcgtgaacgctttcctacgggcgtcgcctactattcggaagacacccattatagcgtgtataagaatctgcgtctgctgaacatgcgtcacatcatgatcaaatcacagccgaatggtgagattgattacggcgatctctacgaaactatgcgcattcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgattccttgcggcatcgttttgacacgcaaacattatgtggagcgtattgctcgcagtatcgaatatgtcggtaccctggacactacgattaccggcagccgtaatggtattacaccgctgtttctttggtacgcggtgaaacaagctggacgcgatggcttcaaacgtcgtgttgcggcatgtctggataacgcccgctatacggtcgagcagtttaaaaagatcggtgtagaagcgcgtcgtaatccatgcgccattaccgttgtgttcccgaaacctccgcagtcagtgctgcacaagtggcaaatcgcagttaacggcgaccgcgcgcatattattttaatgccaagtaccaccctccagcatgtcgatgaattgatcgctgacattgcagccgccaataaagcggctgcagcaccgagcgatacgcagaaacccgccgccaagaaacgcccgacaccggctggtgcaccgcaacgtactacgtag

SEQ ID NO: 204 - protein, 406 aa, Artificial Sequence
  Variant of Leucine Decarboxylase from Planctomycetaceae bacterium
MGNLKFPDGALSPHDRRRLEDVYQYVREQCDTFIGYPCTMHFDYTPLLPFLAYPVNNVGDPFAASSYRVHTREIEREVLAWFAELMHIAPEEYWGYVTNGGTEGNLYGLFLARERFPTGVAYYSEDTHYSVYKNLRLLNMRHIMIKSQPNGEIDYGDLYETMRIHRDCPPIIFANIGTTMTEGIDNVRTIQDMFKKLAIHESHIHCDAALAGMTLPFMDDAPAFDFATGIDSLSISGHKFIGSPIPCGIVLTRKHYVERIARSIEYVGTLDTTITGSRNGITPLFLWYAVKQAGRDGFKRRVAACLDNARYTVEQFKKIGVEARRNPCAITVVFPKPPQSVLHKWQIAVNGDRAHIILMPSTTLQHVDELIADIAAANKAAAAPSDTQKPAAKKRPTPAGAPQRTT

SEQ ID NO: 205 - DNA, 1221 bp, Artificial Sequence
  Variant of Leucine Decarboxylase from Planctomycetaceae bacterium
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctcttttaccgttcctggcctatcccgtcaacaacgtgggcgatccgtttgctgcgtccagttatcgcgtgcatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaacattatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgtatcggtgtagaagcgatgcgtaatccatgcgccattaccgttgtgttcccgaaacctccgcagtcagtgctgcacaagtggcaaatcgcaaccgagggcgaccgcgcgcatatttgcttaatgccaagtaccaccaagcagcatgtcgatgaattgatcgctgacattgcggccgccaataaagcggctgcagcaccgagcgatacgcagaaacccgccgccaagaaacgcccgacaccggctggtgcaccgcaacgtactacgtag

SEQ ID NO: 206 - protein, 406 aa, Artificial Sequence
  Variant of Leucine Decarboxylase from Planctomycetaceae bacterium
MGNLKFPDGALSPTDRRRLEDVYQYVREQCDTFIGYPCNMHFDYTPLLPFLAYPVNNVGDPFAASSYRVHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKHYVERIARSIEYIGTLDTTISGSRNGITPLFLWYAVKQAGRDGFKRRVAACLDNARYTVEQFKRIGVEAMRNPCAITVVFPKPPQSVLHKWQIATEGDRAHICLMPSTTKQHVDELIADIAAANKAAAAPSDTQKPAAKKRPTPAGAPQRTT

SEQ ID NO: 207 - DNA, 1221 bp, Artificial Sequence
  Variant of Leucine Decarboxylase from Planctomycetaceae bacterium
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctcttttaccgttcctggcctatcccgtcaacaacgtgggcgatccgtttgctgcgtccagttatcgcgtgcatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaacattatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgtatcggtgtagaagcgcgtcgtaatccatgcgccattaccgttgtgttcccgaaacctccgcagtcagtgctgcacaagtggcaaatcgcaaccgagggcgactgggcgcatatttgcttaatgccaagtaccacccgtcagcatgtcgatgaattgatcgctgacattgcggccgccaataaagcggctgcagcaccgagcgatacgcagaaacccgccgccaagaaacgcccgacaccggctggtgcaccgcaacgtactacgtag

SEQ ID NO: 208 - protein, 406 aa, Artificial Sequence
  Variant of Leucine Decarboxylase from Planctomycetaceae bacterium
MGNLKFPDGALSPTDRRRLEDVYQYVREQCDTFIGYPCNMHFDYTPLLPFLAYPVNNVGDPFAASSYRVHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKHYVERIARSIEYIGTLDTTISGSRNGITPLFLWYAVKQAGRDGFKRRVAACLDNARYTVEQFKRIGVEARRNPCAITVVFPKPPQSVLHKWQIATEGDWAHICLMPSTTRQHVDELIADIAAANKAAAAPSDTQKPAAKKRPTPAGAPQRTT

SEQ ID NO: 209 - DNA, 1221 bp, Artificial Sequence
  Variant of Leucine Decarboxylase from Planctomycetaceae bacterium
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctcttttaccgttcctggcctatcccgtcaacaacgtgggcgatccgtttgctgagtccagttatcgcgtgcatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcatccatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaacattatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaaaagatcggtgtagaagcgagtcgtaatccatgcgccattaccgttgtgttcccgaaacctccgcagtcagtgctgcataagtggcaaatcgcaaccgagggcgaccgcgcgcatattgtgttaatgccaagtaccacccgtcagcatgtcgatgaattgatcgctgacattgcggccgccaataaagcggctgcagcaccgagcgatacgcagaaacccgccgccaagaaacgcccgacaccggctggtgcaccgcaacgtactacgtag

SEQ ID NO: 210 - protein, 406 aa, Artificial Sequence
  Variant of Leucine Decarboxylase from Planctomycetaceae bacterium
MGNLKFPDGALSPTDRRRLEDVYQYVREQCDTFIGYPCNMHFDYTPLLPFLAYPVNNVGDPFAESSYRVHTREIEREVLAWFAELMHIAPEEYWGYVTNGGSEGNLYGLFLARERFPTGVAYYSEDSHYSVYKNLRLLNMRHIMIKSQPNGEIDYGDLYETMRIHRDCPPIIFANIGTTMTEGIDNVRTIQDMFKKLAIHESHIHCDAALAGMTLPFMDDAPAFDFATGIDSLSISGHKFIGSPMPCGIVLTRKHYVERIARSIEYIGTLDTTISGSRNGITPLFLWYAVKQAGRDGFKRRVAACLDNARYTVEQFKKIGVEASRNPCAITVVFPKPPQSVLHKWQIATEGDRAHIVLMPSTTRQHVDELIADIAAANKAAAAPSDTQKPAAKKRPTPAGAPQRTT

SEQ ID NO: 211 - DNA, 1221 bp, Artificial Sequence
  Variant of Leucine Decarboxylase from Planctomycetaceae bacterium
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctcttttaccgttcctggcctatcccgtcaacaacgtgggcgatccgtttgctgcatccagttatcgcgtgcatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcatccatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaacattatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaaaagatcggtgtagaagcgcgtcgtaatccatgcgccattaccgttgtgttcccgaaacctccgcagtcagtgctggaaaagtggcaaatcgcaaccgagggcgaccgcgcgcatattatgttaatgccaagtaccaccctgcagcatgtcgatgaattgatcgctgacattgcggccgccaataaagcggctgcagcaccgagcgatacgcagaaacccgccgccaagaaacgcccgacaccggctggtgcaccgcaacgtactacgtag

SEQ ID NO: 212 - protein, 406 aa, Artificial Sequence
  Variant of Leucine Decarboxylase from Planctomycetaceae bacterium
MGNLKFPDGALSPTDRRRLEDVYQYVREQCDTFIGYPCNMHFDYTPLLPFLAYPVNNVGDPFAASSYRVHTREIEREVLAWFAELMHIAPEEYWGYVTNGGSEGNLYGLFLARERFPTGVAYYSEDSHYSVYKNLRLLNMRHIMIKSQPNGEIDYGDLYETMRIHRDCPPIIFANIGTTMTEGIDNVRTIQDMFKKLAIHESHIHCDAALAGMTLPFMDDAPAFDFATGIDSLSISGHKFIGSPMPCGIVLTRKHYVERIARSIEYIGTLDTTISGSRNGITPLFLWYAVKQAGRDGFKRRVAACLDNARYTVEQFKKIGVEARRNPCAITVVFPKPPQSVLEKWQIATEGDRAHIMLMPSTTLQHVDELIADIAAANKAAAAPSDTQKPAAKKRPTPAGAPQRTT

SEQ ID NO: 213 - DNA, 1221 bp, Artificial Sequence
  Variant of Leucine Decarboxylase from Planctomycetaceae bacterium
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctcttttaccgttcctggcctatcccgtcaacaacgtgggcgatccgtttgctgcgtccagttatcgcgtgcatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcatccatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaacattatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgaatcgtaatccatgcgccattaccgttgtgttcccgaaacctccgcagtcagtgctgcataagtggcaaatcgcaaccgagggcgactgggcgcatatttgcttaatgccaagtaccaccaagcagcatgtcgatgaattgatcgctgacattgcggccgccaataaagcggctgcagcaccgagcgatacgcagaaacccgccgccaagaaacgcccgacaccggctggtgcaccgcaacgtactacgtag

SEQ ID NO: 214 - protein, 406 aa, Artificial Sequence
  Variant of Leucine Decarboxylase from Planctomycetaceae bacterium
MGNLKFPDGALSPTDRRRLEDVYQYVREQCDTFIGYPCNMHFDYTPLLPFLAYPVNNVGDPFAASSYRVHTREIEREVLAWFAELMHIAPEEYWGYVTNGGSEGNLYGLFLARERFPTGVAYYSEDSHYSVYKNLRLLNMRHIMIKSQPNGEIDYGDLYETMRIHRDCPPIIFANIGTTMTEGIDNVRTIQDMFKKLAIHESHIHCDAALAGMTLPFMDDAPAFDFATGIDSLSISGHKFIGSPMPCGIVLTRKHYVERIARSIEYIGTLDTTISGSRNGITPLFLWYAVKQAGRDGFKRRVAACLDNARYTVEQFKRIGVEANRNPCAITVVFPKPPQSVLHKWQIATEGDWAHICLMPSTTKQHVDELIADIAAANKAAAAPSDTQKPAAKKRPTPAGAPQRTT

SEQ ID NO: 215 - DNA, 1221 bp, Artificial Sequence
  Variant of Leucine Decarboxylase from Planctomycetaceae bacterium
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctcttttcccgttcctggcctatcccgtcaacaacgtgggcgatccgtttgctgagtccagttatcgcgtgcatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcatccatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaacattatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgtatcggtgtagaagcgcgtcgtaatccatgcgccattaccgttgtgttcccgaaacctccgcagtcagtgctgcacaagtggcaaatcgcaaccgagggcgaccgcgcgcatattatgttaatgccaagtaccaccaagcagcatgtcgatgaattgatcgctgacattgcggccgccaataaagcggctgcagcaccgagcgatacgcagaaacccgccgccaagaaacgcccgacaccggctggtgcaccgcaacgtactacgtag

SEQ ID NO: 216 - protein, 406 aa, Artificial Sequence
  Variant of Leucine Decarboxylase from Planctomycetaceae bacterium
MGNLKFPDGALSPTDRRRLEDVYQYVREQCDTFIGYPCNMHFDYTPLFPFLAYPVNNVGDPFAESSYRVHTREIEREVLAWFAELMHIAPEEYWGYVTNGGSEGNLYGLFLARERFPTGVAYYSEDSHYSVYKNLRLLNMRHIMIKSQPNGEIDYGDLYETMRIHRDCPPIIFANIGTTMTEGIDNVRTIQDMFKKLAIHESHIHCDAALAGMTLPFMDDAPAFDFATGIDSLSISGHKFIGSPMPCGIVLTRKHYVERIARSIEYIGTLDTTISGSRNGITPLFLWYAVKQAGRDGFKRRVAACLDNARYTVEQFKRIGVEARRNPCAITVVFPKPPQSVLHKWQIATEGDRAHIMLMPSTTKQHVDELIADIAAANKAAAAPSDTQKPAAKKRPTPAGAPQRTT

SEQ ID NO: 217 - DNA, 1221 bp, Artificial Sequence
  Variant of Leucine Decarboxylase from Planctomycetaceae bacterium
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctcttttaccgttcctggcctatcccgtcaacaacgtgggcgatccgtttgctgagtccagttatcgcgtgcatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcatccatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaacattatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgtatcggtgtagaagcgatgcgtaatccatgcgccattaccgttgtgttcccgaaacctccgcagtcagtgctgcataagtggcaaatcgcaaccgagggcgacaatgcgcatatttgcttaatgccaagtaccacccgtcagcatgtcgatgaattgatcgctgacattgcggccgccaataaagcggctgcagcaccgagcgatacgcagaaacccgccgccaagaaacgcccgacaccggctggtgcaccgcaacgtactacgtag

SEQ ID NO: 218 - protein, 406 aa, Artificial Sequence
  Variant of Leucine Decarboxylase from Planctomycetaceae bacterium
MGNLKFPDGALSPTDRRRLEDVYQYVREQCDTFIGYPCNMHFDYTPLLPFLAYPVNNVGDPFAESSYRVHTREIEREVLAWFAELMHIAPEEYWGYVTNGGSEGNLYGLFLARERFPTGVAYYSEDSHYSVYKNLRLLNMRHIMIKSQPNGEIDYGDLYETMRIHRDCPPIIFANIGTTMTEGIDNVRTIQDMFKKLAIHESHIHCDAALAGMTLPFMDDAPAFDFATGIDSLSISGHKFIGSPMPCGIVLTRKHYVERIARSIEYIGTLDTTISGSRNGITPLFLWYAVKQAGRDGFKRRVAACLDNARYTVEQFKRIGVEAMRNPCAITVVFPKPPQSVLHKWQIATEGDNAHICLMPSTTRQHVDELIADIAAANKAAAAPSDTQKPAAKKRPTPAGAPQRTT

SEQ ID NO: 219 - DNA, 1221 bp, Artificial Sequence
  Variant of Leucine Decarboxylase from Planctomycetaceae bacterium
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctcttttaccgttcctggcctatcccgtcaacaacgtgggcgatccgtttgctgcgtccagttatcgcgtgcatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgctgccatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaacattatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgtatcggtgtagaagcgcgtcgtaatccatgcgccattaccgttgtgttcccgaaacctccgcagtcagtgctgcataagtggcaaatcgcaaccgagggcgactgggcgcatatttgcttaatgccaagtaccacccgtcagcatgtcgatgaattgatcgctgacattgcggccgccaataaagcggctgcagcaccgagcgatacgcagaaacccgccgccaagaaacgcccgacaccggctggtgcaccgcaacgtactacgtag

SEQ ID NO: 220 - protein, 406 aa, Artificial Sequence
  Variant of Leucine Decarboxylase from Planctomycetaceae bacterium
MGNLKFPDGALSPTDRRRLEDVYQYVREQCDTFIGYPCNMHFDYTPLLPFLAYPVNNVGDPFAASSYRVHTREIEREVLAWFAELMHIAPEEYWGYVTNGGSEGNLYGLFLARERFPTGVAYYSEDSHYSVYKNLRLLNMRHIMIKSQPNGEIDYGDLYETMRCHRDCPPIIFANIGTTMTEGIDNVRTIQDMFKKLAIHESHIHCDAALAGMTLPFMDDAPAFDFATGIDSLSISGHKFIGSPMPCGIVLTRKHYVERIARSIEYIGTLDTTISGSRNGITPLFLWYAVKQAGRDGFKRRVAACLDNARYTVEQFKRIGVEARRNPCAITVVFPKPPQSVLHKWQIATEGDWAHICLMPSTTRQHVDELIADIAAANKAAAAPSDTQKPAAKKRPTPAGAPQRTT

SEQ ID NO: 221 - DNA, 1221 bp, Artificial Sequence
  Variant of Leucine Decarboxylase from Planctomycetaceae bacterium
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctcttttaccgttcctggcctatcccgtcaacaacgtgggcgatccgtttgctgagtccagttatcgcgtgcatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgctgccatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaacattatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgcgtcgtaatccatgcgccattaccgttgtgttcccgaaacctccgcagtcagtgctgcacaagtggcaaatcgcaaccgagggcgacgatgcgcatattgtgttaatgccaagtaccaccctgcagcatgtcgatgaattgatcgctgacattgcggccgccaataaagcggctgcagcaccgagcgatacgcagaaacccgccgccaagaaacgcccgacaccggctggtgcaccgcaacgtactacgtag

SEQ ID NO: 222 - protein, 406 aa, Artificial Sequence
  Variant of Leucine Decarboxylase from Planctomycetaceae bacterium
MGNLKFPDGALSPTDRRRLEDVYQYVREQCDTFIGYPCNMHFDYTPLLPFLAYPVNNVGDPFAESSYRVHTREIEREVLAWFAELMHIAPEEYWGYVTNGGSEGNLYGLFLARERFPTGVAYYSEDSHYSVYKNLRLLNMRHIMIKSQPNGEIDYGDLYETMRCHRDCPPIIFANIGTTMTEGIDNVRTIQDMFKKLAIHESHIHCDAALAGMTLPFMDDAPAFDFATGIDSLSISGHKFIGSPMPCGIVLTRKHYVERIARSIEYIGTLDTTISGSRNGITPLFLWYAVKQAGRDGFKRRVAACLDNARYTVEQFKRIGVEARRNPCAITVVFPKPPQSVLHKWQIATEGDDAHIVLMPSTTLQHVDELIADIAAANKAAAAPSDTQKPAAKKRPTPAGAPQRTT

SEQ ID NO: 223 - DNA, 1221 bp, Artificial Sequence
  Variant of Leucine Decarboxylase from Planctomycetaceae bacterium
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctcttttaccgttcctggcctatcccgtcaacaacgtgggcgatccgtttgctgcgtccagttatcgcgtgcatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgctgccatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaacattatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgtatcggtgtagaagcgatgcgtaatccatgcgccattaccgttgtgttcccgaaacctccgcagtcagtgctggaaaagtggcaaatcgcaaccgagggcgacgatgcgcatattgtgttaatgccaagtaccacccgtcagcatgtcgatgaattgatcgctgacattgcggccgccaataaagcggctgcagcaccgagcgatacgcagaaacccgccgccaagaaacgcccgacaccggctggtgcaccgcaacgtactacgtag

SEQ ID NO: 224 - protein, 406 aa, Artificial Sequence
  Variant of Leucine Decarboxylase from Planctomycetaceae bacterium
MGNLKFPDGALSPTDRRRLEDVYQYVREQCDTFIGYPCNMHFDYTPLLPFLAYPVNNVGDPFAASSYRVHTREIEREVLAWFAELMHIAPEEYWGYVTNGGSEGNLYGLFLARERFPTGVAYYSEDSHYSVYKNLRLLNMRHIMIKSQPNGEIDYGDLYETMRCHRDCPPIIFANIGTTMTEGIDNVRTIQDMFKKLAIHESHIHCDAALAGMTLPFMDDAPAFDFATGIDSLSISGHKFIGSPMPCGIVLTRKHYVERIARSIEYIGTLDTTISGSRNGITPLFLWYAVKQAGRDGFKRRVAACLDNARYTVEQFKRIGVEAMRNPCAITVVFPKPPQSVLEKWQIATEGDDAHIVLMPSTTRQHVDELIADIAAANKAAAAPSDTQKPAAKKRPTPAGAPQRTT

SEQ ID NO: 225 - DNA, 1221 bp, Artificial Sequence
  Variant of Leucine Decarboxylase from Planctomycetaceae bacterium
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctcttttaccgttcctggcctatcccgtcaacaacgtgggcgatccgtttgctgcgtccagttatcgcgtgcatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcatccatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaacattatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaaaagatcggtgtagaagcgcgtcgtaatccatgcgccattaccgttgtgttcccgaaacctccgcagtcagtgctggaaaagtggcaaatcgcaaccgagggcgaccgcgcgcatatttgcttaatgccaagtaccaccctgcagcatgtcgatgaattgatcgctgacattgcggccgccaataaagcggctgcagcaccgagcgatacgcagaaacccgccgccaagaaacgcccgacaccggctggtgcaccgcaacgtactacgtag

SEQ ID NO: 226 - protein, 406 aa, Artificial Sequence
  Variant of Leucine Decarboxylase from Planctomycetaceae bacterium
MGNLKFPDGALSPTDRRRLEDVYQYVREQCDTFIGYPCNMHFDYTPLLPFLAYPVNNVGDPFAASSYRVHTREIEREVLAWFAELMHIAPEEYWGYVTNGGSEGNLYGLFLARERFPTGVAYYSEDSHYSVYKNLRLLNMRHIMIKSQPNGEIDYGDLYETMRIHRDCPPIIFANIGTTMTEGIDNVRTIQDMFKKLAIHESHIHCDAALAGMTLPFMDDAPAFDFATGIDSLSISGHKFIGSPMPCGIVLTRKHYVERIARSIEYIGTLDTTISGSRNGITPLFLWYAVKQAGRDGFKRRVAACLDNARYTVEQFKKIGVEARRNPCAITVVFPKPPQSVLEKWQIATEGDRAHICLMPSTTLQHVDELIADIAAANKAAAAPSDTQKPAAKKRPTPAGAPQRTT

SEQ ID NO: 227 - DNA, 1221 bp, Artificial Sequence
  Variant of Leucine Decarboxylase from Planctomycetaceae bacterium
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctcttttaccgttcctggcctatcccgtcaacaacgtgggcgatccgtttgctgcgtccagttatcgcgtgcatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaacattatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgtatcggtgtagaagcgcgtcgtaatccatgcgccattaccgttgtgttcccgaaacctccgcagtcagtgctgcacaagtggcaaatcgcaaccgagggcgaccgcgcgcatattattttaatgccaagtaccacccgtcagcatgtcgatgaattgatcgctgacattgcggccgccaataaagcggctgcagcaccgagcgatacgcagaaacccgccgccaagaaacgcccgacaccggctggtgcaccgcaacgtactacgtag

SEQ ID NO: 228 - protein, 406 aa, Artificial Sequence
  Variant of Leucine Decarboxylase from Planctomycetaceae bacterium
MGNLKFPDGALSPTDRRRLEDVYQYVREQCDTFIGYPCNMHFDYTPLLPFLAYPVNNVGDPFAASSYRVHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKHYVERIARSIEYIGTLDTTISGSRNGITPLFLWYAVKQAGRDGFKRRVAACLDNARYTVEQFKRIGVEARRNPCAITVVFPKPPQSVLHKWQIATEGDRAHIILMPSTTRQHVDELIADIAAANKAAAAPSDTQKPAAKKRPTPAGAPQRTT

SEQ ID NO: 229 - DNA, 1221 bp, Artificial Sequence
  Variant of Leucine Decarboxylase from Planctomycetaceae bacterium
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctcttttcccgttcctggcctatcccgtcaacaacgtgggcgatccgtttgctgagtccagttatcgcgtgcatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaacattatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgtatcggtgtagaagcgatgcgtaatccatgcgccattaccgttgtgttcccgaaacctccgcagtcagtgctggaaaagtggcaaatcgcaaccgagggcgaccgcgcgcatattatcttaatgccaagtaccacccgtcagcatgtcgatgaattgatcgctgacattgcggccgccaataaagcggctgcagcaccgagcgatacgcagaaacccgccgccaagaaacgcccgacaccggctggtgcaccgcaacgtactacgtag

SEQ ID NO: 230 - protein, 406 aa, Artificial Sequence
  Variant of Leucine Decarboxylase from Planctomycetaceae bacterium
MGNLKFPDGALSPTDRRRLEDVYQYVREQCDTFIGYPCNMHFDYTPLFPFLAYPVNNVGDPFAESSYRVHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKHYVERIARSIEYIGTLDTTISGSRNGITPLFLWYAVKQAGRDGFKRRVAACLDNARYTVEQFKRIGVEAMRNPCAITVVFPKPPQSVLEKWQIATEGDRAHIILMPSTTRQHVDELIADIAAANKAAAAPSDTQKPAAKKRPTPAGAPQRTT

SEQ ID NO: 231 - DNA, 1221 bp, Artificial Sequence
  Variant of Leucine Decarboxylase from Planctomycetaceae bacterium
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctcttttaccgttcctggcctatcccgtcaacaacgtgggcgatccgtttgctgcgtccagttatcgcgtgcatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgctgccatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaacattatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaaaagatcggtgtagaagcgagtcgtaatccatgcgccattaccgttgtgttcccgaaacctccgcagtcagtgctgcacaagtggcaaatcgcaaccgagggcgaccgcgcgcatattgtgttaatgccaagtaccacccgtcagcatgtcgatgaattgatcgctgacattgcggccgccaataaagcggctgcagcaccgagcgatacgcagaaacccgccgccaagaaacgcccgacaccggctggtgcaccgcaacgtactacgtag

SEQ ID NO: 232 - protein, 406 aa, Artificial Sequence
  Variant of Leucine Decarboxylase from Planctomycetaceae bacterium
MGNLKFPDGALSPTDRRRLEDVYQYVREQCDTFIGYPCNMHFDYTPLLPFLAYPVNNVGDPFAASSYRVHTREIEREVLAWFAELMHIAPEEYWGYVTNGGSEGNLYGLFLARERFPTGVAYYSEDSHYSVYKNLRLLNMRHIMIKSQPNGEIDYGDLYETMRCHRDCPPIIFANIGTTMTEGIDNVRTIQDMFKKLAIHESHIHCDAALAGMTLPFMDDAPAFDFATGIDSLSISGHKFIGSPMPCGIVLTRKHYVERIARSIEYIGTLDTTISGSRNGITPLFLWYAVKQAGRDGFKRRVAACLDNARYTVEQFKKIGVEASRNPCAITVVFPKPPQSVLHKWQIATEGDRAHIVLMPSTTRQHVDELIADIAAANKAAAAPSDTQKPAAKKRPTPAGAPQRTT

SEQ ID NO: 233 - DNA, 1221 bp, Artificial Sequence
  Variant of Leucine Decarboxylase from Planctomycetaceae bacterium
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctcttttaccgttcctggcctatcccgtcaacaacgtgggcgatccgtttgctgcgtccagttatcgcgtgcatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaacattatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagcggctgcagcaccgagcgatacgcagaaacccgccgccaagaaacgcccgacaccggctggtgcaccgcaacgtactacgtag

SEQ ID NO: 234 - protein, 406 aa, Artificial Sequence
  Variant of Leucine Decarboxylase from Planctomycetaceae bacterium
MGNLKFPDGALSPTDRRRLEDVYQYVREQCDTFIGYPCNMHFDYTPLLPFLAYPVNNVGDPFAASSYRVHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKHYVERIARSIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTRQHVDELIADIAAANKAAAAPSDTQKPAAKKRPTPAGAPQRTT

SEQ ID NO: 235 - DNA, 1221 bp, Artificial Sequence
  Variant of Leucine Decarboxylase from Planctomycetaceae bacterium
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctcttttcccgttcctggcctatcccgtcaacaacgtgggcgatccgtttgctgagtccagttatcgcgtgcatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaacattatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgtatcggtgtagaagcgatgcgtaatccatgcgccattaccgttgtgttcccgaaacctccgcagtcagtgctggaaaagtggcaaatcgcaaccgagggcgacgaggcgcatatttgcttaatgccaagtaccaccaagcagcatgtcgatgaattgatcgctgacattgcggccgccaataaagcggctgcagcaccgagcgatacgcagaaacccgccgccaagaaacgcccgacaccggctggtgcaccgcaacgtactacgtag

SEQ ID NO: 236 - protein, 406 aa, Artificial Sequence
  Variant of Leucine Decarboxylase from Planctomycetaceae bacterium
MGNLKFPDGALSPTDRRRLEDVYQYVREQCDTFIGYPCNMHFDYTPLFPFLAYPVNNVGDPFAESSYRVHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKHYVERIARSIEYIGTLDTTISGSRNGITPLFLWYAVKQAGRDGFKRRVAACLDNARYTVEQFKRIGVEAMRNPCAITVVFPKPPQSVLEKWQIATEGDEAHICLMPSTTKQHVDELIADIAAANKAAAAPSDTQKPAAKKRPTPAGAPQRTT

SEQ ID NO: 237 - DNA, 1221 bp, Artificial Sequence
  Variant of Leucine Decarboxylase from Planctomycetaceae bacterium
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctcttttaccgttcctggcctatcccgtcaacaacgtgggcgatccgtttgctgcgtccagttatcgcgtgcatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcatccatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaacattatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgtatcggtgtagaagcgatgcgtaatccatgcgccattaccgttgtgttcccgaaacctccgcagtcagtgctgcacaagtggcaaatcgcaaccgagggcgaccgcgcgcatattatgttaatgccaagtaccacccgtcagcatgtcgatgaattgatcgctgacattgcggccgccaataaagcggctgcagcaccgagcgatacgcagaaacccgccgccaagaaacgcccgacaccggctggtgcaccgcaacgtactacgtag

SEQ ID NO: 238 - protein, 406 aa, Artificial Sequence
  Variant of Leucine Decarboxylase from Planctomycetaceae bacterium
MGNLKFPDGALSPTDRRRLEDVYQYVREQCDTFIGYPCNMHFDYTPLLPFLAYPVNNVGDPFAASSYRVHTREIEREVLAWFAELMHIAPEEYWGYVTNGGSEGNLYGLFLARERFPTGVAYYSEDSHYSVYKNLRLLNMRHIMIKSQPNGEIDYGDLYETMRIHRDCPPIIFANIGTTMTEGIDNVRTIQDMFKKLAIHESHIHCDAALAGMTLPFMDDAPAFDFATGIDSLSISGHKFIGSPMPCGIVLTRKHYVERIARSIEYIGTLDTTISGSRNGITPLFLWYAVKQAGRDGFKRRVAACLDNARYTVEQFKRIGVEAMRNPCAITVVFPKPPQSVLHKWQIATEGDRAHIMLMPSTTRQHVDELIADIAAANKAAAAPSDTQKPAAKKRPTPAGAPQRTT

SEQ ID NO: 239 - DNA, 1221 bp, Artificial Sequence
  Variant of Leucine Decarboxylase from Planctomycetaceae bacterium
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctcttttaccgttcctggcctatcccgtcaacaacgtgggcgatccgtttgctgcgtccagttatcgcgtgcatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaacattatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaaaagatcggtgtagaagcgatgcgtaatccatgcgccattaccgttgtgttcccgaaacctccgcagtcagtgctggaaaagtggcaaatcgcaaccgagggcgacgaggcgcatatttgcttaatgccaagtaccaccctccagcatgtcgatgaattgatcgctgacattgcggccgccaataaagcggctgcagcaccgagcgatacgcagaaacccgccgccaagaaacgcccgacaccggctggtgcaccgcaacgtactacgtag

SEQ ID NO: 240 - protein, 406 aa, Artificial Sequence
  Variant of Leucine Decarboxylase from Planctomycetaceae bacterium
MGNLKFPDGALSPTDRRRLEDVYQYVREQCDTFIGYPCNMHFDYTPLLPFLAYPVNNVGDPFAASSYRVHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKHYVERIARSIEYIGTLDTTISGSRNGITPLFLWYAVKQAGRDGFKRRVAACLDNARYTVEQFKKIGVEAMRNPCAITVVFPKPPQSVLEKWQIATEGDEAHICLMPSTTLQHVDELIADIAAANKAAAAPSDTQKPAAKKRPTPAGAPQRTT

SEQ ID NO: 241 - DNA, 1221 bp, Artificial Sequence
  Variant of Leucine Decarboxylase from Planctomycetaceae bacterium
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctcttttaccgttcctggcctatcccgtcaacaacgtgggcgatccgtttgctgcgtccagttatcgcgtgcatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgctgccatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaacattatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgtatcggtgtagaagcgcgtcgtaatccatgcgccattaccgttgtgttcccgaaacctccgcagtcagtgctgcacaagtggcaaatcgcaaccgagggcgacgatgcgcatattgtgttaatgccaagtaccacccgtcagcatgtcgatgaattgatcgctgacattgcggccgccaataaagcggctgcagcaccgagcgatacgcagaaacccgccgccaagaaacgcccgacaccggctggtgcaccgcaacgtactacgtag

SEQ ID NO: 242 - protein, 406 aa, Artificial Sequence
  Variant of Leucine Decarboxylase from Planctomycetaceae bacterium
MGNLKFPDGALSPTDRRRLEDVYQYVREQCDTFIGYPCNMHFDYTPLLPFLAYPVNNVGDPFAASSYRVHTREIEREVLAWFAELMHIAPEEYWGYVTNGGSEGNLYGLFLARERFPTGVAYYSEDSHYSVYKNLRLLNMRHIMIKSQPNGEIDYGDLYETMRCHRDCPPIIFANIGTTMTEGIDNVRTIQDMFKKLAIHESHIHCDAALAGMTLPFMDDAPAFDFATGIDSLSISGHKFIGSPMPCGIVLTRKHYVERIARSIEYIGTLDTTISGSRNGITPLFLWYAVKQAGRDGFKRRVAACLDNARYTVEQFKRIGVEARRNPCAITVVFPKPPQSVLHKWQIATEGDDAHIVLMPSTTRQHVDELIADIAAANKAAAAPSDTQKPAAKKRPTPAGAPQRTT

SEQ ID NO: 243 - DNA, 1221 bp, Artificial Sequence
  Variant of Leucine Decarboxylase from Planctomycetaceae bacterium
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctcttttaccgttcctggcctatcccgtcaacaacgtgggcgatccgtttgctgagtccagttatcgcgtgcatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaacattatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgcgccattaccgttgtgttcccgaaacctccgcagtcagtgctggaaaagtggcaaatcgcaaccgagggcgacgatgcgcatattgtgttaatgccaagtaccaccaagcagcatgtcgatgaattgatcgctgacattgcggccgccaataaagcggctgcagcaccgagcgatacgcagaaacccgccgccaagaaacgcccgacaccggctggtgcaccgcaacgtactacgtag

SEQ ID NO: 244 - protein, 406 aa, Artificial Sequence
  Variant of Leucine Decarboxylase from Planctomycetaceae bacterium
MGNLKFPDGALSPTDRRRLEDVYQYVREQCDTFIGYPCNMHFDYTPLLPFLAYPVNNVGDPFAESSYRVHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKHYVERIARSIEYIGTLDTTISGSRNGITPLFLWYAVKQAGRDGFKRRVAACLDNARYTVEQFKRIGVEAMRNPCAITVVFPKPPQSVLEKWQIATEGDDAHIVLMPSTTKQHVDELIADIAAANKAAAAPSDTQKPAAKKRPTPAGAPQRTT

SEQ ID NO: 245 - DNA, 1221 bp, Artificial Sequence
  Variant of Leucine Decarboxylase from Planctomycetaceae bacterium
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctcttttcccgttcctggcctatcccgtcaacaacgtgggcgatccgtttgctgagtccagttatcgcgtgcatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgctgccatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaacattatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgtatcggtgtagaagcgcgtcgtaatccatgcgccattaccgttgtgttcccgaaacctccgcagtcagtgctgcataagtggcaaatcgcaaccgagggcgacaatgcgcatattgtgttaatgccaagtaccacccgtcagcatgtcgatgaattgatcgctgacattgcggccgccaataaagcggctgcagcaccgagcgatacgcagaaacccgccgccaagaaacgcccgacaccggctggtgcaccgcaacgtactacgtag

SEQ ID NO: 246 - protein, 406 aa, Artificial Sequence
  Variant of Leucine Decarboxylase from Planctomycetaceae bacterium
MGNLKFPDGALSPTDRRRLEDVYQYVREQCDTFIGYPCNMHFDYTPLFPFLAYPVNNVGDPFAESSYRVHTREIEREVLAWFAELMHIAPEEYWGYVTNGGSEGNLYGLFLARERFPTGVAYYSEDSHYSVYKNLRLLNMRHIMIKSQPNGEIDYGDLYETMRCHRDCPPIIFANIGTTMTEGIDNVRTIQDMFKKLAIHESHIHCDAALAGMTLPFMDDAPAFDFATGIDSLSISGHKFIGSPMPCGIVLTRKHYVERIARSIEYIGTLDTTISGSRNGITPLFLWYAVKQAGRDGFKRRVAACLDNARYTVEQFKRIGVEARRNPCAITVVFPKPPQSVLHKWQIATEGDNAHIVLMPSTTRQHVDELIADIAAANKAAAAPSDTQKPAAKKRPTPAGAPQRTT

SEQ ID NO: 247 - DNA, 1221 bp, Artificial Sequence
  Variant of Leucine Decarboxylase from Planctomycetaceae bacterium
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctcttttaccgttcctggcctatcccgtcaacaacgtgggcgatccgtttgctgcgtccagttatcgcgtgcatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcatccatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaacattatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgcgccattaccgttgtgttcccgaaacctccgcagtcagtgctggaaaagtggcaaatcgcaaccgagggcgaccgcgcgcatattgtgttaatgccaagtaccaccaagcagcatgtcgatgaattgatcgctgacattgcggccgccaataaagcggctgcagcaccgagcgatacgcagaaacccgccgccaagaaacgcccgacaccggctggtgcaccgcaacgtactacgtag

SEQ ID NO: 248 - protein, 406 aa, Artificial Sequence
  Variant of Leucine Decarboxylase from Planctomycetaceae bacterium
MGNLKFPDGALSPTDRRRLEDVYQYVREQCDTFIGYPCNMHFDYTPLLPFLAYPVNNVGDPFAASSYRVHTREIEREVLAWFAELMHIAPEEYWGYVTNGGSEGNLYGLFLARERFPTGVAYYSEDSHYSVYKNLRLLNMRHIMIKSQPNGEIDYGDLYETMRIHRDCPPIIFANIGTTMTEGIDNVRTIQDMFKKLAIHESHIHCDAALAGMTLPFMDDAPAFDFATGIDSLSISGHKFIGSPMPCGIVLTRKHYVERIARSIEYIGTLDTTISGSRNGITPLFLWYAVKQAGRDGFKRRVAACLDNARYTVEQFKRIGVEAMRNPCAITVVFPKPPQSVLEKWQIATEGDRAHIVLMPSTTKQHVDELIADIAAANKAAAAPSDTQKPAAKKRPTPAGAPQRTT

SEQ ID NO: 249 - DNA, 1221 bp, Artificial Sequence
  Variant of Leucine Decarboxylase from Planctomycetaceae bacterium
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctcttttaccgttcctggcctatcccgtcaacaacgtgggcgatccgtttgctgcgtccagttatcgcgtgcatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgctgccatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaacattatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgtatcggtgtagaagcgcgtcgtaatccatgcgccattaccgttgtgttcccgaaacctccgcagtcagtgctgcataagtggcaaatcgcaaccgagggcgacgatgcgcatattgtgttaatgccaagtaccaccaagcagcatgtcgatgaattgatcgctgacattgcggccgccaataaagcggctgcagcaccgagcgatacgcagaaacccgccgccaagaaacgcccgacaccggctggtgcaccgcaacgtactacgtag

SEQ ID NO: 250 - protein, 406 aa, Artificial Sequence
  Variant of Leucine Decarboxylase from Planctomycetaceae bacterium
MGNLKFPDGALSPTDRRRLEDVYQYVREQCDTFIGYPCNMHFDYTPLLPFLAYPVNNVGDPFAASSYRVHTREIEREVLAWFAELMHIAPEEYWGYVTNGGSEGNLYGLFLARERFPTGVAYYSEDSHYSVYKNLRLLNMRHIMIKSQPNGEIDYGDLYETMRCHRDCPPIIFANIGTTMTEGIDNVRTIQDMFKKLAIHESHIHCDAALAGMTLPFMDDAPAFDFATGIDSLSISGHKFIGSPMPCGIVLTRKHYVERIARSIEYIGTLDTTISGSRNGITPLFLWYAVKQAGRDGFKRRVAACLDNARYTVEQFKRIGVEARRNPCAITVVFPKPPQSVLHKWQIATEGDDAHIVLMPSTTKQHVDELIADIAAANKAAAAPSDTQKPAAKKRPTPAGAPQRTT

SEQ ID NO: 251 - DNA, 1221 bp, Artificial Sequence
  Variant of Leucine Decarboxylase from Planctomycetaceae bacterium
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctcttttaccgttcctggcctatcccgtcaacaacgtgggcgatccgtttgctgcgtccagttatcgcgtgcatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcattcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaacattatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgtatcggtgtagaagcgcgtcgtaatccatgcgccattaccgttgtgttcccgaaacctccgcagtcagtgctgcataagtggcaaatcgcaaccgagggcgaccgcgcgcatattgtgttaatgccaagtaccacccgtcagcatgtcgatgaattgatcgctgacattgcggccgccaataaagcggctgcagcaccgagcgatacgcagaaacccgccgccaagaaacgcccgacaccggctggtgcaccgcaacgtactacgtag

SEQ ID NO: 252 - protein, 406 aa, Artificial Sequence
  Variant of Leucine Decarboxylase from Planctomycetaceae bacterium
MGNLKFPDGALSPTDRRRLEDVYQYVREQCDTFIGYPCNMHFDYTPLLPFLAYPVNNVGDPFAASSYRVHTREIEREVLAWFAELMHIAPEEYWGYVTNGGSEGNLYGLFLARERFPTGVAYYSEDSHYSVYKNLRLLNMRHIMIKSQPNGEIDYGDLYETMRIHRDCPPIIFANIGTTMTEGIDNVRTIQDMFKKLAIHESHIHCDAALAGMTLPFMDDAPAFDFATGIDSLSISGHKFIGSPMPCGIVLTRKHYVERIARSIEYIGTLDTTISGSRNGITPLFLWYAVKQAGRDGFKRRVAACLDNARYTVEQFKRIGVEARRNPCAITVVFPKPPQSVLHKWQIATEGDRAHIVLMPSTTRQHVDELIADIAAANKAAAAPSDTQKPAAKKRPTPAGAPQRTT

SEQ ID NO: 253 - DNA, 1221 bp, Artificial Sequence
  Variant of Leucine Decarboxylase from Planctomycetaceae bacterium
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctcttttaccgttcctggcctatcccgtcaacaacgtgggcgatccgtttgctgcatccagttatcgcgtgcatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaaggatctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaacattatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgtatcggtgtagaagcgatgcgtaatccatgcgccattaccgttgtgttcccgaaacctccgcagtcagtgctgcataagtggcaaatcgcaaccgagggcgaccgcgcgcatatttgcttaatgccaagtaccaccaagcagcatgtcgatgaattgatcgctgacattgcggccgccaataaagcggctgcagcaccgagcgatacgcagaaacccgccgccaagaaacgcccgacaccggctggtgcaccgcaacgtactacgtag

SEQ ID NO: 254 - protein, 406 aa, Artificial Sequence
  Variant of Leucine Decarboxylase from Planctomycetaceae bacterium
MGNLKFPDGALSPTDRRRLEDVYQYVREQCDTFIGYPCNMHFDYTPLLPFLAYPVNNVGDPFAASSYRVHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKDLAIHESHIHCDAALAGMTLPFMDDAPAFDFATGIDSLSISGHKFIGSPMPCGIVLTRKHYVERIARSIEYIGTLDTTISGSRNGITPLFLWYAVKQAGRDGFKRRVAACLDNARYTVEQFKRIGVEAMRNPCAITVVFPKPPQSVLHKWQIATEGDRAHICLMPSTTKQHVDELIADIAAANKAAAAPSDTQKPAAKKRPTPAGAPQRTT

SEQ ID NO: 255 - DNA, 1221 bp, Artificial Sequence
  Variant of Leucine Decarboxylase from Planctomycetaceae bacterium
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctcttttaccgttcctggcctatcccgtcaacaacgtgggcgatccgtttgctgcatccagttatcgcgtgcatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcattcatcgtgattgcccgccgatcatcttcgctaacattggtacgacgatgaccgaaggcattgacaacgtacgcaccatccaggatatgttcaaggatctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaacattatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaaaagatcggtgtagaagcgatgcgtaatccatgcgccattaccgttgtgttcccgaaacctccgcagtcagtgctgcataagtggcaaatcgcaaccgagggcgacaatgcgcatatttgcttaatgccaagtaccaccaagcagcatgtcgatgaattgatcgctgacattgcggccgccaataaagcggctgcagcaccgagcgatacgcagaaacccgccgccaagaaacgcccgacaccggctggtgcaccgcaacgtactacgtag

SEQ ID NO: 256 - protein, 406 aa, Artificial Sequence
  Variant of Leucine Decarboxylase from Planctomycetaceae bacterium
MGNLKFPDGALSPTDRRRLEDVYQYVREQCDTFIGYPCNMHFDYTPLLPFLAYPVNNVGDPFAASSYRVHTREIEREVLAWFAELMHIAPEEYWGYVTNGGSEGNLYGLFLARERFPTGVAYYSEDSHYSVYKNLRLLNMRHIMIKSQPNGEIDYGDLYETMRIHRDCPPIIFANIGTTMTEGIDNVRTIQDMFKDLAIHESHIHCDAALAGMTLPFMDDAPAFDFATGIDSLSISGHKFIGSPMPCGIVLTRKHYVERIARSIEYIGTLDTTISGSRNGITPLFLWYAVKQAGRDGFKRRVAACLDNARYTVEQFKKIGVEAMRNPCAITVVFPKPPQSVLHKWQIATEGDNAHICLMPSTTKQHVDELIADIAAANKAAAAPSDTQKPAAKKRPTPAGAPQRTT

SEQ ID NO: 257 - DNA, 1221 bp, Artificial Sequence
  Variant of Leucine Decarboxylase from Planctomycetaceae bacterium
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctcttttaccgttcctggcctatcccgtcaacaacgtgggcgatccgtttgctgagtccagttatcgcgtgcatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaacattatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgtatcggtgtagaagcgatgcgtaatccatgcgccattaccgttgtgttcccgaaacctccgcagtcagtgctggaaaagtggcaaatcgcaaccgagggcgaccgcgcgcatatttgcttaatgccaagtaccacccgtcagcatgtcgatgaattgatcgctgacattgcggccgccaataaagcggctgcagcaccgagcgatacgcagaaacccgccgccaagaaacgcccgacaccggctggtgcaccgcaacgtactacgtag

SEQ ID NO: 258 - protein, 406 aa, Artificial Sequence
  Variant of Leucine Decarboxylase from Planctomycetaceae bacterium
MGNLKFPDGALSPTDRRRLEDVYQYVREQCDTFIGYPCNMHFDYTPLLPFLAYPVNNVGDPFAESSYRVHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKHYVERIARSIEYIGTLDTTISGSRNGITPLFLWYAVKQAGRDGFKRRVAACLDNARYTVEQFKRIGVEAMRNPCAITVVFPKPPQSVLEKWQIATEGDRAHICLMPSTTRQHVDELIADIAAANKAAAAPSDTQKPAAKKRPTPAGAPQRTT

SEQ ID NO: 259 - DNA, 1221 bp, Artificial Sequence
  Variant of Leucine Decarboxylase from Planctomycetaceae bacterium
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctcttttaccgttcctggcctatcccgtcaacaacgtgggcgatccgtttgctgcatccagttatcgcgtgcatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcattcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaacattatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgcgtcgtaatccatgcgccattaccgttgtgttcccgaaacctccgcaatcagtgctgcacaagtggcaaatcgcaaccgagggcgaccgcgcgcatattatcttaatgccaagtaccaccctccagcatgtcgatgaattgatcgctgacattgcggccgccaataaagcggctgcagcaccgagcgatacgcaggggcccgccgccaaggaagatccggccccggctggtgcaccgcaacgtgacacgtag

SEQ ID NO: 260 - protein, 406 aa, Artificial Sequence
  Variant of Leucine Decarboxylase from Planctomycetaceae bacterium
MGNLKFPDGALSPTDRRRLEDVYQYVREQCDTFIGYPCNMHFDYTPLLPFLAYPVNNVGDPFAASSYRVHTREIEREVLAWFAELMHIAPEEYWGYVTNGGSEGNLYGLFLARERFPTGVAYYSEDSHYSVYKNLRLLNMRHIMIKSQPNGEIDYGDLYETMRIHRDCPPIIFANIGTTMTEGIDNVRTIQDMFKKLAIHESHIHCDAALAGMTLPFMDDAPAFDFATGIDSLSISGHKFIGSPMPCGIVLTRKHYVERIARSIEYIGTLDTTISGSRNGITPLFLWYAVKQAGRDGFKRRVAACLDNARYTVEQFKRIGVEARRNPCAITVVFPKPPQSVLHKWQIATEGDRAHIILMPSTTLQHVDELIADIAAANKAAAAPSDTQGPAAKEDPAPAGAPQRDT

SEQ ID NO: 261 - DNA, 1221 bp, Artificial Sequence
  Variant of Leucine Decarboxylase from Planctomycetaceae bacterium
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctcttttaccgttcctggcctatcccgtcaacaacgtgggcgatccgtttgctgcatccagttatcgcgtgcatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtttaagaatctgcgtctgctgaacatgcgtcacatcatgatcaaatcacagccgaatggtgagattgattacggcgatctctacgaaactatgcgcattcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagcgtattgctcgcagtatcgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgcgtcgtaatccatgcgccattaccgttgtgttcccgaaacctccggcgtcagtgctgcacaagtggcaaatcgcaaccgagggcgaccgcgcgcatattatcttaatgccaagtaccaccctccagcatgtcgatgaattgatcgctgacattgcggccgccaatgatgcggctgcagcaccgagcgatacgcagaaacccgccgccaagaaagatccgaccccggctggtgcaccgcaacgtactacgtag

SEQ ID NO: 262 - protein, 406 aa, Artificial Sequence
  Variant of Leucine Decarboxylase from Planctomycetaceae bacterium
MGNLKFPDGALSPTDRRRLEDVYQYVREQCDTFIGYPCNMHFDYTPLLPFLAYPVNNVGDPFAASSYRVHTREIEREVLAWFAELMHIAPEEYWGYVTNGGSEGNLYGLFLARERFPTGVAYYSEDSHYSVFKNLRLLNMRHIMIKSQPNGEIDYGDLYETMRIHRDCPPIIFANIGTTMTEGIDNVRTIQDMFKKLAIHESHIHCDAALAGMTLPFMDDAPAFDFATGIDSLSISGHKFIGSPMPCGIVLTRKPYVERIARSIEYIGTLDTTISGSRNGITPLFLWYAVKQAGRDGFKRRVAACLDNARYTVEQFKRIGVEARRNPCAITVVFPKPPASVLHKWQIATEGDRAHIILMPSTTLQHVDELIADIAAANDAAAAPSDTQKPAAKKDPTPAGAPQRTT

SEQ ID NO: 263 - DNA, 1158 bp, Artificial Sequence
  Variant of Leucine Decarboxylase from Planctomycetaceae bacterium
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctcttttaccgttcctggcctatcccgtcaacaacgtgggcgatccgtttgctgcatccagttatcgcgtgcatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcattcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaacattatgtggagcgtattgctcgcagtatcgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgcgtcgtaatccatgcgccattaccgttgtgttcccgaaacctccgcaatcagtgctgcacaagtggcaaatcgcaaccgagggcgaccgcgcgcatattatcttaatgccaagtaccaccctccagcatgtcgatgaattgatcgctgacattgcggccgccaatgatgcggctgcagcaccgagctaa

SEQ ID NO: 264 - protein, 385 aa, Artificial Sequence
  Variant of Leucine Decarboxylase from Planctomycetaceae bacterium
MGNLKFPDGALSPTDRRRLEDVYQYVREQCDTFIGYPCNMHFDYTPLLPFLAYPVNNVGDPFAASSYRVHTREIEREVLAWFAELMHIAPEEYWGYVTNGGSEGNLYGLFLARERFPTGVAYYSEDSHYSVYKNLRLLNMRHIMIKSQPNGEIDYGDLYETMRIHRDCPPIIFANIGTTMTEGIDNVRTIQDMFKKLAIHESHIHCDAALAGMTLPFMDDAPAFDFATGIDSLSISGHKFIGSPMPCGIVLTRKHYVERIARSIEYIGTLDTTISGSRNGITPLFLWYAVKQAGRDGFKRRVAACLDNARYTVEQFKRIGVEARRNPCAITVVFPKPPQSVLHKWQIATEGDRAHIILMPSTTLQHVDELIADIAAANDAAAAPS

SEQ ID NO: 265 - DNA, 1221 bp, Artificial Sequence
  Variant of Leucine Decarboxylase from Planctomycetaceae bacterium
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctcttttaccgttcctggcctatcccgtcaacaacgtgggcgatccgtttgctgcatccagttatcgcgtgcatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcattcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaacattatgtggagcgtattgctcgcagtatcgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgcgtcgtaatccatgcgccattaccgttgtgttcccgaaacctccggcgtcagtgctgcacaagtggcaaatcgcaaccgagggcgaccgcgcgcatattatcttaatgccaagtaccaccctccagcatgtcgatgaattgatcgctgacattgcggccgccaataaagcggctgcagcaccgagcgatacgcagaaaccctaagccaagaaacgcccgacaccggctggtgcaccgcaacgtactacgtag

SEQ ID NO: 266 - protein, 390 aa, Artificial Sequence
  Variant of Leucine Decarboxylase from Planctomycetaceae bacterium
MGNLKFPDGALSPTDRRRLEDVYQYVREQCDTFIGYPCNMHFDYTPLLPFLAYPVNNVGDPFAASSYRVHTREIEREVLAWFAELMHIAPEEYWGYVTNGGSEGNLYGLFLARERFPTGVAYYSEDSHYSVYKNLRLLNMRHIMIKSQPNGEIDYGDLYETMRIHRDCPPIIFANIGTTMTEGIDNVRTIQDMFKKLAIHESHIHCDAALAGMTLPFMDDAPAFDFATGIDSLSISGHKFIGSPMPCGIVLTRKHYVERIARSIEYIGTLDTTISGSRNGITPLFLWYAVKQAGRDGFKRRVAACLDNARYTVEQFKRIGVEARRNPCAITVVFPKPPASVLHKWQIATEGDRAHIILMPSTTLQHVDELIADIAAANKAAAAPSDTQKP

SEQ ID NO: 267 - DNA, 1221 bp, Artificial Sequence
  Variant of Leucine Decarboxylase from Planctomycetaceae bacterium
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctcttttaccgttcctggcctatcccgtcaacaacgtgggcgatccgtttgctgcatccagttatcgcgtgcatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcattcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaacattatgtggagcgtattgctcgcagtatcgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgcgtcgtaatccatgcgccattaccgttgtgttcccgaaacctccggcgtcagtgctgcacaagtggcaaatcgcaaccgagggcgaccgcgcgcatattatcttaatgccaagtaccaccctccagcatgtcgatgaattgatcgctgacattgcggccgccaataaagcggctgcagcaccgagcgatacgcaggggcccgccgccaagaaaaaaccgaccccggctggtgcaccgcaacgtactacgtag

SEQ ID NO: 268 - protein, 406 aa, Artificial Sequence
  Variant of Leucine Decarboxylase from Planctomycetaceae bacterium
MGNLKFPDGALSPTDRRRLEDVYQYVREQCDTFIGYPCNMHFDYTPLLPFLAYPVNNVGDPFAASSYRVHTREIEREVLAWFAELMHIAPEEYWGYVTNGGSEGNLYGLFLARERFPTGVAYYSEDSHYSVYKNLRLLNMRHIMIKSQPNGEIDYGDLYETMRIHRDCPPIIFANIGTTMTEGIDNVRTIQDMFKKLAIHESHIHCDAALAGMTLPFMDDAPAFDFATGIDSLSISGHKFIGSPMPCGIVLTRKHYVERIARSIEYIGTLDTTISGSRNGITPLFLWYAVKQAGRDGFKRRVAACLDNARYTVEQFKRIGVEARRNPCAITVVFPKPPASVLHKWQIATEGDRAHIILMPSTTLQHVDELIADIAAANKAAAAPSDTQGPAAKKKPTPAGAPQRTT

SEQ ID NO: 269 - DNA, 1221 bp, Artificial Sequence
  Variant of Leucine Decarboxylase from Planctomycetaceae bacterium
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctcttttaccgttcctggcctatcccgtcaacaacgtgggcgatccgtttgctgcatccagttatcgcgtgcatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcattcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaacattatgtggagcgtattgctcgcagtatcgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgcgtcgtaatccatgcgccattaccgttgtgttcccgaaacctccgcaatcagtgctgcacaagtggcaaatcgcaaccgagggcgaccgcgcgcatattatcttaatgccaagtaccaccctccagcatgtcgatgaattgatcgctgacattgcggccgccaatgatgcggctgcagcaccgagcgatacgcagaaacccgccgccaaggaagatccggccccggctggtgcaccgcaaattcacacgtag

SEQ ID NO: 270 - protein, 406 aa, Artificial Sequence
  Variant of Leucine Decarboxylase from Planctomycetaceae bacterium
MGNLKFPDGALSPTDRRRLEDVYQYVREQCDTFIGYPCNMHFDYTPLLPFLAYPVNNVGDPFAASSYRVHTREIEREVLAWFAELMHIAPEEYWGYVTNGGSEGNLYGLFLARERFPTGVAYYSEDSHYSVYKNLRLLNMRHIMIKSQPNGEIDYGDLYETMRIHRDCPPIIFANIGTTMTEGIDNVRTIQDMFKKLAIHESHIHCDAALAGMTLPFMDDAPAFDFATGIDSLSISGHKFIGSPMPCGIVLTRKHYVERIARSIEYIGTLDTTISGSRNGITPLFLWYAVKQAGRDGFKRRVAACLDNARYTVEQFKRIGVEARRNPCAITVVFPKPPQSVLHKWQIATEGDRAHIILMPSTTLQHVDELIADIAAANDAAAAPSDTQKPAAKEDPAPAGAPQIHT

SEQ ID NO: 271 - DNA, 1221 bp, Artificial Sequence
  Variant of Leucine Decarboxylase from Planctomycetaceae bacterium
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctcttttaccgttcctggcctatcccgtcaacaacgtgggcgatccgtttgctgcatccagttatcgcgtgcatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcattcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaacattatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgcgtcgtaatccatgcgccattaccgttgtgttcccgaaacctccgcaatcagtgctgcacaagtggcaaatcgcaaccgagggcgaccgcgcgcatattatcttaatgccaagtaccaccctccagcatgtcgatgaattgatcgctgacattgcggccgccaatgatgcggctgcagcaccgagcgatacgcagaaacccgccgccaaggaaaaaccggccccggctggtgcaccgcaacgtgacacgtag

SEQ ID NO: 272 - protein, 406 aa, Artificial Sequence
  Variant of Leucine Decarboxylase from Planctomycetaceae bacterium
MGNLKFPDGALSPTDRRRLEDVYQYVREQCDTFIGYPCNMHFDYTPLLPFLAYPVNNVGDPFAASSYRVHTREIEREVLAWFAELMHIAPEEYWGYVTNGGSEGNLYGLFLARERFPTGVAYYSEDSHYSVYKNLRLLNMRHIMIKSQPNGEIDYGDLYETMRIHRDCPPIIFANIGTTMTEGIDNVRTIQDMFKKLAIHESHIHCDAALAGMTLPFMDDAPAFDFATGIDSLSISGHKFIGSPMPCGIVLTRKHYVERIARSIEYIGTLDTTISGSRNGITPLFLWYAVKQAGRDGFKRRVAACLDNARYTVEQFKRIGVEARRNPCAITVVFPKPPQSVLHKWQIATEGDRAHIILMPSTTLQHVDELIADIAAANDAAAAPSDTQKPAAKEKPAPAGAPQRDT

SEQ ID NO: 273 - DNA, 1221 bp, Artificial Sequence
  Variant of Leucine Decarboxylase from Planctomycetaceae bacterium
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctcttttaccgttcctggcctatcccgtcaacaacgtgggcgatccgtttgctgcatccagttatcgcgtgcatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcattcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaacattatgtggagcgtattgctcgcagtatcgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgcgtcgtaatccatgcgccattaccgttgtgttcccgaaacctccggcgtcagtgctgcacaagtggcaaatcgcaaccgagggcgaccgcgcgcatattatcttaatgccaagtaccaccctccagcatgtcgatgaattgatcgctgacattgcggccgccaataaagcggctgcagcaccgagcgatacgcagaaacccgccgccaaggaaaaaccgaccccggctggtgcaccgcaacgtgacacgtag

SEQ ID NO: 274 - protein, 406 aa, Artificial Sequence
  Variant of Leucine Decarboxylase from Planctomycetaceae bacterium
MGNLKFPDGALSPTDRRRLEDVYQYVREQCDTFIGYPCNMHFDYTPLLPFLAYPVNNVGDPFAASSYRVHTREIEREVLAWFAELMHIAPEEYWGYVTNGGSEGNLYGLFLARERFPTGVAYYSEDSHYSVYKNLRLLNMRHIMIKSQPNGEIDYGDLYETMRIHRDCPPIIFANIGTTMTEGIDNVRTIQDMFKKLAIHESHIHCDAALAGMTLPFMDDAPAFDFATGIDSLSISGHKFIGSPMPCGIVLTRKHYVERIARSIEYIGTLDTTISGSRNGITPLFLWYAVKQAGRDGFKRRVAACLDNARYTVEQFKRIGVEARRNPCAITVVFPKPPASVLHKWQIATEGDRAHIILMPSTTLQHVDELIADIAAANKAAAAPSDTQKPAAKEKPTPAGAPQRDT

SEQ ID NO: 275 - DNA, 1221 bp, Artificial Sequence
  Variant of Leucine Decarboxylase from Planctomycetaceae bacterium
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctcttttaccgttcctggcctatcccgtcaacaacgtgggcgatccgtttgctgcatccagttatcgcgtgcatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcattcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaacattatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgcgtcgtaatccatgcgccattaccgttgtgttcccgaaacctccgcagtcagtgctgcacaagtggcaaatcgcaaccgagggcgaccgcgcgcatattatcttaatgccaagtaccaccctccagcatgtcgatgaattgatcgctgacattgcggccgccaataaagcggctgcagcaccgagcgatacgcagaaacccgccgccaaggaacgtccggccccggctggtgcaccgcaacgtactacgtag

SEQ ID NO: 276 - protein, 406 aa, Artificial Sequence
  Variant of Leucine Decarboxylase from Planctomycetaceae bacterium
MGNLKFPDGALSPTDRRRLEDVYQYVREQCDTFIGYPCNMHFDYTPLLPFLAYPVNNVGDPFAASSYRVHTREIEREVLAWFAELMHIAPEEYWGYVTNGGSEGNLYGLFLARERFPTGVAYYSEDSHYSVYKNLRLLNMRHIMIKSQPNGEIDYGDLYETMRIHRDCPPIIFANIGTTMTEGIDNVRTIQDMFKKLAIHESHIHCDAALAGMTLPFMDDAPAFDFATGIDSLSISGHKFIGSPMPCGIVLTRKHYVERIARSIEYIGTLDTTISGSRNGITPLFLWYAVKQAGRDGFKRRVAACLDNARYTVEQFKRIGVEARRNPCAITVVFPKPPQSVLHKWQIATEGDRAHIILMPSTTLQHVDELIADIAAANKAAAAPSDTQKPAAKERPAPAGAPQRTT

SEQ ID NO: 277 - DNA, 1221 bp, Artificial Sequence
  Variant of Leucine Decarboxylase from Planctomycetaceae bacterium
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctcttttaccgttcctggcctatcccgtcaacaacgtgggcgatccgtttgctgcatccagttatcgcgtgcatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcattcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaacattatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgcgtcgtaatccatgcgccattaccgttgtgttcccgaaacctccggcgtcagtgctgcacaagtggcaaatcgcaaccgagggcgaccgcgcgcatattatcttaatgccaagtaccaccctccagcatgtcgatgaattgatcgctgacattgcggccgccaatgatgcggctgcagcaccgagcgatacgcaggggcccgccgccaaggaagatccgaccccggctggtgcaccgcaacgtactacgtag

SEQ ID NO: 278 - protein, 406 aa, Artificial Sequence
  Variant of Leucine Decarboxylase from Planctomycetaceae bacterium
MGNLKFPDGALSPTDRRRLEDVYQYVREQCDTFIGYPCNMHFDYTPLLPFLAYPVNNVGDPFAASSYRVHTREIEREVLAWFAELMHIAPEEYWGYVTNGGSEGNLYGLFLARERFPTGVAYYSEDSHYSVYKNLRLLNMRHIMIKSQPNGEIDYGDLYETMRIHRDCPPIIFANIGTTMTEGIDNVRTIQDMFKKLAIHESHIHCDAALAGMTLPFMDDAPAFDFATGIDSLSISGHKFIGSPMPCGIVLTRKHYVERIARSIEYIGTLDTTISGSRNGITPLFLWYAVKQAGRDGFKRRVAACLDNARYTVEQFKRIGVEARRNPCAITVVFPKPPASVLHKWQIATEGDRAHIILMPSTTLQHVDELIADIAAANDAAAAPSDTQGPAAKEDPTPAGAPQRTT

SEQ ID NO: 279 - DNA, 1218 bp, Artificial Sequence
  Variant of Leucine Decarboxylase from Planctomycetaceae bacterium
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctcttctgccgttcctggcctatcccgtcaacaacgtgggcgatccgtttgctgcatccagttatcgcgtgcatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaacattatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaaaaaatcggtgtagaagcgatgcgtaatccatgcgccattaccgttgtgttcccgaaacctccggcttcagtgctggaaaagtggcaaatcgcaaccgagggcgacgatgcgcatatttgcttaatgccaagtaccacccgtcagcatgtcgatgaattgatcgctgacattgcggccgccaatgatgcggctgcagcaccgagcgatacgcagaaacccgccgccaagaaacgcccgacaccggctggtgcaccgcaacgtactacg

SEQ ID NO: 280 - protein, 406 aa, Artificial Sequence
  Variant of Leucine Decarboxylase from Planctomycetaceae bacterium
MGNLKFPDGALSPTDRRRLEDVYQYVREQCDTFIGYPCNMHFDYTPLLPFLAYPVNNVGDPFAASSYRVHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKHYVERIARSIEYIGTLDTTISGSRNGITPLFLWYAVKQAGRDGFKRRVAACLDNARYTVEQFKKIGVEAMRNPCAITVVFPKPPASVLEKWQIATEGDDAHICLMPSTTRQHVDELIADIAAANDAAAAPSDTQKPAAKKRPTPAGAPQRTT

SEQ ID NO: 281 - DNA, 1218 bp, Artificial Sequence
  Variant of Leucine Decarboxylase from Planctomycetaceae bacterium
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctcttttaccgttcctggcctatcccgtcaacaacgtgggcgatccgtttgctgaatccagttatcgcgtgcatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgcgccattaccgttgtgttcccgaaacctccgcaatcagtgctggaaaagtggcaaatcgcaaccgagggcgacgatgcgcatatttgcttaatgccaagtaccacccgtcagcatgtcgatgaattgatcgctgacattgcggccgccaataaagcggctgcagcaccgagcgatacgcagaaacccgccgccaagaaacgcccgacaccggctggtgcaccgcaacgtactacg

SEQ ID NO: 282 - protein, 406 aa, Artificial Sequence
  Variant of Leucine Decarboxylase from Planctomycetaceae bacterium
MGNLKFPDGALSPTDRRRLEDVYQYVREQCDTFIGYPCNMHFDYTPLLPFLAYPVNNVGDPFAESSYRVHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKPYVERIARSIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTRQHVDELIADIAAANKAAAAPSDTQKPAAKKRPTPAGAPQRTT

SEQ ID NO: 283 - DNA, 1218 bp, Artificial Sequence
  Variant of Leucine Decarboxylase from Planctomycetaceae bacterium
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctgaatccagttatcgcgtgcatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagcggctgcagcaccgagcgatacgcagaaacccgccgccaagaaacgcccgacaccggctggtgcaccgcaacgtactacg

SEQ ID NO: 284 - protein, 406 aa, Artificial Sequence
  Variant of Leucine Decarboxylase from Planctomycetaceae bacterium
MGNLKFPDGALSPTDRRRLEDVYQYVREQCDTFIGYPCNMHFDYTPLFPFLAYPVNNVGDPFAESSYRVHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKPYVERIARSIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTRQHVDELIADIAAANKAAAAPSDTQKPAAKKRPTPAGAPQRTT

SEQ ID NO: 285 - DNA, 1218 bp, Artificial Sequence
  Variant of Leucine Decarboxylase from Planctomycetaceae bacterium
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctcttttaccgttcctggcctatcccgtcaacaacgtgggcgatccgtttgctgcatccagttatcgcgtgcatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagcggctgcagcaccgagcgatacgcagaaacccgccgccaagaaacgcccgacaccggctggtgcaccgcaacgtactacg

SEQ ID NO: 286 - protein, 406 aa, Artificial Sequence
  Variant of Leucine Decarboxylase from Planctomycetaceae bacterium
MGNLKFPDGALSPTDRRRLEDVYQYVREQCDTFIGYPCNMHFDYTPLLPFLAYPVNNVGDPFAASSYRVHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKPYVERIARSIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTRQHVDELIADIAAANKAAAAPSDTQKPAAKKRPTPAGAPQRTT

SEQ ID NO: 287 - DNA, 1218 bp, Artificial Sequence
  Variant of Leucine Decarboxylase from Planctomycetaceae bacterium
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctcttttaccgttcctggcctatcccgtcaacaacgtgggcgatccgtttgctgcatccagttatcgcgtgcatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaacattatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagcggctgcagcaccgagcgatacgcagaaacccgccgccaagaaacgcccgacaccggctggtgcaccgcaacgtcacacg

SEQ ID NO: 288 - protein, 406 aa, Artificial Sequence
  Variant of Leucine Decarboxylase from Planctomycetaceae bacterium
MGNLKFPDGALSPTDRRRLEDVYQYVREQCDTFIGYPCNMHFDYTPLLPFLAYPVNNVGDPFAASSYRVHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKHYVERIARSIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTRQHVDELIADIAAANKAAAAPSDTQKPAAKKRPTPAGAPQRHT

SEQ ID NO: 289 - DNA, 1218 bp, Artificial Sequence
  Variant of Leucine Decarboxylase from Planctomycetaceae bacterium
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctcttctgccgttcctggcctatcccgtcaacaacgtgggcgatccgtttgctgcatccagttatcgcgtgcatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaaaaaatcggtgtagaagcgatgcgtaatccatgcgccattaccgttgtgttcccgaaacctccgcaatcagtgctggaaaagtggcaaatcgcaaccgagggcgacgatgcgcatatttgcttaatgccaagtaccacccgtcagcatgtcgatgaattgatcgctgacattgcggccgccaatgatgcggctgcagcaccgagcgatacgcagaaacccgccgccaagaaacgcccgacaccggctggtgcaccgcaacgtactacg

SEQ ID NO: 290 - protein, 406 aa, Artificial Sequence
  Variant of Leucine Decarboxylase from Planctomycetaceae bacterium
MGNLKFPDGALSPTDRRRLEDVYQYVREQCDTFIGYPCNMHFDYTPLLPFLAYPVNNVGDPFAASSYRVHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKPYVERIARSIEYIGTLDTTISGSRNGITPLFLWYAVKQAGRDGFKRRVAACLDNARYTVEQFKKIGVEAMRNPCAITVVFPKPPQSVLEKWQIATEGDDAHICLMPSTTRQHVDELIADIAAANDAAAAPSDTQKPAAKKRPTPAGAPQRTT

SEQ ID NO: 291 - DNA, 1218 bp, Artificial Sequence
  Variant of Leucine Decarboxylase from Planctomycetaceae bacterium
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctgcatccagttatcgcgtgcatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgcgccattaccgttgtgttcccgaaacctccgcaatcagtgctggaaaagtggcaaatcgcaaccgagggcgacgatgcgcatatttgcttaatgccaagtaccacccgtcagcatgtcgatgaattgatcgctgacattgcggccgccaatgatgcggctgcagcaccgagcgatacgcagaaacccgccgccaagaaacgcccgacaccggctggtgcaccgcaacgtactacg

SEQ ID NO: 292 - protein, 406 aa, Artificial Sequence
  Variant of Leucine Decarboxylase from Planctomycetaceae bacterium
MGNLKFPDGALSPTDRRRLEDVYQYVREQCDTFIGYPCNMHFDYTPLFPFLAYPVNNVGDPFAASSYRVHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKPYVERIARSIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTRQHVDELIADIAAANDAAAAPSDTQKPAAKKRPTPAGAPQRTT

SEQ ID NO: 293 - DNA, 1218 bp, Artificial Sequence
  Variant of Leucine Decarboxylase from Planctomycetaceae bacterium
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctcttttaccgttcctggcctatcccgtcaacaacgtgggcgatccgtttgctgaatccagttatcgcgtgcatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaacattatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgcgccattaccgttgtgttcccgaaacctccgcaatcagtgctggaaaagtggcaaatcgcaaccgagggcgacgatgcgcatatttgcttaatgccaagtaccacccgtcagcatgtcgatgaattgatcgctgacattgcggccgccaataaagcggctgcagcaccgagcgatacgcagaaacccgccgccaagaaacgcccgacaccggctggtgcaccgcaacgtactacg

SEQ ID NO: 294 - protein, 406 aa, Artificial Sequence
  Variant of Leucine Decarboxylase from Planctomycetaceae bacterium
MGNLKFPDGALSPTDRRRLEDVYQYVREQCDTFIGYPCNMHFDYTPLLPFLAYPVNNVGDPFAESSYRVHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKHYVERIARSIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTRQHVDELIADIAAANKAAAAPSDTQKPAAKKRPTPAGAPQRTT

SEQ ID NO: 295 - DNA, 1218 bp, Artificial Sequence
  Variant of Leucine Decarboxylase from Planctomycetaceae bacterium
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctcttttaccgttcctggcctatcccgtcaacaacgtgggcgatccgtttgctgcgtccagttatcgcgtgcatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaacattatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgcgccattaccgttgtgttcccgaaacctccggcttcagtgctggaaaagtggcaaatcgcaaccgagggcgacgatgcgcatatttgcttaatgccaagtaccacccgtcagcatgtcgatgaattgatcgctgacattgcggccgccaataaagcggctgcagcaccgagcgatacgcagaaacccgccgccaagaaacgcccgacaccggctggtgcaccgcaacgtactacg

SEQ ID NO: 296 - protein, 406 aa, Artificial Sequence
  Variant of Leucine Decarboxylase from Planctomycetaceae bacterium
MGNLKFPDGALSPTDRRRLEDVYQYVREQCDTFIGYPCNMHFDYTPLLPFLAYPVNNVGDPFAASSYRVHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKHYVERIARSIEYIGTLDTTISGSRNGITPLFLWYAVKQAGRDGFKRRVAACLDNARYTVEQFKRIGVEAMRNPCAITVVFPKPPASVLEKWQIATEGDDAHICLMPSTTRQHVDELIADIAAANKAAAAPSDTQKPAAKKRPTPAGAPQRTT

SEQ ID NO: 297 - DNA, 1218 bp, Artificial Sequence
  Variant of Leucine Decarboxylase from Planctomycetaceae bacterium
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctgcatccagttatcgcgtgcatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgcgccattaccgttgtgttcccgaaacctccggcttcagtgctggaaaagtggcaaatcgcaaccgagggcgacgatgcgcatatttgcttaatgccaagtaccacccgtcagcatgtcgatgaattgatcgctgacattgcggccgccaataaagcggctgcagcaccgagcgatacgcagaaacccgccgccaagaaacgcccgacaccggctggtgcaccgcaacgtactacg

SEQ ID NO: 298 - protein, 406 aa, Artificial Sequence
  Variant of Leucine Decarboxylase from Planctomycetaceae bacterium
MGNLKFPDGALSPTDRRRLEDVYQYVREQCDTFIGYPCNMHFDYTPLFPFLAYPVNNVGDPFAASSYRVHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKPYVERIARSIEYIGTLDTTISGSRNGITPLFLWYAVKQAGRDGFKRRVAACLDNARYTVEQFKRIGVEAMRNPCAITVVFPKPPASVLEKWQIATEGDDAHICLMPSTTRQHVDELIADIAAANKAAAAPSDTQKPAAKKRPTPAGAPQRTT

SEQ ID NO: 299 - DNA, 1218 bp, Artificial Sequence
  Variant of Leucine Decarboxylase from Planctomycetaceae bacterium
atggagaatctgaaatttccagatggcgcgttgagcccgaccgaccgccgccgtctggaagatgtgtatcagtacgttcgtgagcaatgcgacaccttcatcgggtatccgtgcaacatgcactttgattacacacctcttttaccgttcctggcctatcccgtcaacaacgtgggcgatccgtttgctgcgtccagttatcgcgtgcatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaacattatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagcggctgcagcaccgagcgatacgcagaaacccgccgccaagaaacgcccgacaccggctggtgcaccgcaacgtactacg

SEQ ID NO: 300 - protein, 406 aa, Artificial Sequence
  Variant of Leucine Decarboxylase from Planctomycetaceae bacterium
MENLKFPDGALSPTDRRRLEDVYQYVREQCDTFIGYPCNMHFDYTPLLPFLAYPVNNVGDPFAASSYRVHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKHYVERIARSIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTRQHVDELIADIAAANKAAAAPSDTQKPAAKKRPTPAGAPQRTT

SEQ ID NO: 301 - DNA, 1218 bp, Artificial Sequence
  Variant of Leucine Decarboxylase from Planctomycetaceae bacterium
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctcttttaccgttcctggcctatcccgtcaacaacgtgggcgatccgtttgctgcgtccagttatcgcgtgcatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaacattatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagaggctgcagcaccgagcgatacgcagaaacccgccgccaagaaacgcccgacaccggctggtgcaccgcaacgtactacg

SEQ ID NO: 302 - protein, 406 aa, Artificial Sequence
  Variant of Leucine Decarboxylase from Planctomycetaceae bacterium
MGNLKFPDGALSPTDRRRLEDVYQYVREQCDTFIGYPCNMHFDYTPLLPFLAYPVNNVGDPFAASSYRVHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKHYVERIARSIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTRQHVDELIADIAAANKEAAAPSDTQKPAAKKRPTPAGAPQRTT

SEQ ID NO: 303 - DNA, 1218 bp, Artificial Sequence
  Variant of Leucine Decarboxylase from Planctomycetaceae bacterium
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctcttttaccgttcctggcctatcccgtcaacaacgtgggcgatccgtttgctgcgtccagttatcgcgtgcatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaacattatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgcgccattaccgttgtgttcccgaaacctccgcaggtggtgctggaaaagtggcaaatcgcaaccgagggcgacgatgcgcatatttgcttaatgccaagtaccacccgtcagcatgtcgatgaattgatcgctgacattgcggccgccaataaagcggctgcagcaccgagcgatacgcagaaacccgccgccaagaaacgcccgacaccggctggtgcaccgcaacgtactacg

SEQ ID NO: 304 - protein, 406 aa, Artificial Sequence
  Variant of Leucine Decarboxylase from Planctomycetaceae bacterium
MGNLKFPDGALSPTDRRRLEDVYQYVREQCDTFIGYPCNMHFDYTPLLPFLAYPVNNVGDPFAASSYRVHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKHYVERIARSIEYIGTLDTTISGSRNGITPLFLWYAVKQAGRDGFKRRVAACLDNARYTVEQFKRIGVEAMRNPCAITVVFPKPPQVVLEKWQIATEGDDAHICLMPSTTRQHVDELIADIAAANKAAAAPSDTQKPAAKKRPTPAGAPQRTT

SEQ ID NO: 305 - DNA, 1218 bp, Artificial Sequence
  Variant of Leucine Decarboxylase from Planctomycetaceae bacterium
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctcttttaccgttcctggcctatcccgtcaacaacgtgggcgatccgtttgctgcgtccagttatcgcgtgcatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaacattatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagcggctagtgcaccgagcgatacgcagaaacccgccgccaagaaacgcccgacaccggctggtgcaccgcaacgtactacg

SEQ ID NO: 306 - protein, 406 aa, Artificial Sequence
  Variant of Leucine Decarboxylase from Planctomycetaceae bacterium
MGNLKFPDGALSPTDRRRLEDVYQYVREQCDTFIGYPCNMHFDYTPLLPFLAYPVNNVGDPFAASSYRVHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKHYVERIARSIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTRQHVDELIADIAAANKAASAPSDTQKPAAKKRPTPAGAPQRTT

SEQ ID NO: 307 - DNA, 1218 bp, Artificial Sequence
  Variant of Leucine Decarboxylase from Planctomycetaceae bacterium
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctcttttaccgttcctggcctatcccgtcaacaacgtgggcgatccgtttgctgcgtccagttatcgcgtgcatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaacattatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagcggctgcagcaccgagcgatacgcagaaagcggccgccaagaaacgcccgacaccggctggtgcaccgcaacgtactacg

SEQ ID NO: 308 - protein, 406 aa, Artificial Sequence
  Variant of Leucine Decarboxylase from Planctomycetaceae bacterium
MGNLKFPDGALSPTDRRRLEDVYQYVREQCDTFIGYPCNMHFDYTPLLPFLAYPVNNVGDPFAASSYRVHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKHYVERIARSIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTRQHVDELIADIAAANKAAAAPSDTQKAAAKKRPTPAGAPQRTT

SEQ ID NO: 309 - DNA, 1218 bp, Artificial Sequence
  Variant of Leucine Decarboxylase from Planctomycetaceae bacterium
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctcttttaccgttcctggcctatcccgtcaacaacgtgggcgatccgtttgctgcgtccagttatcgcgtgcatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaagtgatgcgcgctcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaacattatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagcggctgcagcaccgagcgatacgcagaaacccgccgccaagaaacgcccgacaccggctggtgcaccgcaacgtactacg

SEQ ID NO: 310 - protein, 406 aa, Artificial Sequence
  Variant of Leucine Decarboxylase from Planctomycetaceae bacterium
MGNLKFPDGALSPTDRRRLEDVYQYVREQCDTFIGYPCNMHFDYTPLLPFLAYPVNNVGDPFAASSYRVHTREIEREVLAWFAELMHIAPEEYWGYVTNGGSEGNLYGLFLARERFPTGVAYYSEDSHYSVYKNLRLLNMRHIMIKSQPNGEIDYGDLYEVMRAHRDCPPIIFANIGTTMTEGIDNVRTIQDMFKKLAIHESHIHCDAALAGMTLPFMDDAPAFDFATGIDSLSISGHKFIGSPMPCGIVLTRKHYVERIARSIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTRQHVDELIADIAAANKAAAAPSDTQKPAAKKRPTPAGAPQRTT

SEQ ID NO: 311 - DNA, 1218 bp, Artificial Sequence
  Variant of Leucine Decarboxylase from Planctomycetaceae bacterium
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctcttttaccgttcctggcctatcccgtcaacaacgtgggcgatccgtttgctagttccagttatcgcgtgcatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaacattatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagcggctgcagcaccgagcgatacgcagaaacccgccgccaagaaacgcccgacaccggctggtgcaccgcaacgtactacg

SEQ ID NO: 312 - protein, 406 aa, Artificial Sequence
  Variant of Leucine Decarboxylase from Planctomycetaceae bacterium
MGNLKFPDGALSPTDRRRLEDVYQYVREQCDTFIGYPCNMHFDYTPLLPFLAYPVNNVGDPFASSSYRVHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKHYVERIARSIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTRQHVDELIADIAAANKAAAAPSDTQKPAAKKRPTPAGAPQRTT

SEQ ID NO: 313 - DNA, 1218 bp, Artificial Sequence
  Variant of Leucine Decarboxylase from Planctomycetaceae bacterium
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctcttttaccgttcctggcctatcccgtcaacaacgtgggcgatccgtttgctgcgtccagttatcgcgtgcatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatattttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaacattatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagcggctgcagcaccgagcgatacgcagaaacccgccgccaagaaacgcccgacaccggctggtgcaccgcaacgtactacg

SEQ ID NO: 314 - protein, 406 aa, Artificial Sequence
  Variant of Leucine Decarboxylase from Planctomycetaceae bacterium
MGNLKFPDGALSPTDRRRLEDVYQYVREQCDTFIGYPCNMHFDYTPLLPFLAYPVNNVGDPFAASSYRVHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDIFKKLAIHESHIHCDAALAGMTLPFMDDAPAFDFATGIDSLSISGHKFIGSPMPCGIVLTRKHYVERIARSIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTRQHVDELIADIAAANKAAAAPSDTQKPAAKKRPTPAGAPQRTT

SEQ ID NO: 315 - DNA, 1218 bp, Artificial Sequence
  Variant of Leucine Decarboxylase from Planctomycetaceae bacterium
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctcttttaccgttcctggcctatcccgtcaacaacgtgggcgatccgtttgctgcgtccagttatcgcattcatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaacattatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagcggctgcagcaccgagcgatacgcagaaacccgccgccaagaaacgcccgacaccggctggtgcaccgcaacgtactacg

SEQ ID NO: 316 - protein, 406 aa, Artificial Sequence
  Variant of Leucine Decarboxylase from Planctomycetaceae bacterium
MGNLKFPDGALSPTDRRRLEDVYQYVREQCDTFIGYPCNMHFDYTPLLPFLAYPVNNVGDPFAASSYRIHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKHYVERIARSIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTRQHVDELIADIAAANKAAAAPSDTQKPAAKKRPTPAGAPQRTT

SEQ ID NO: 317 - DNA, 1218 bp, Artificial Sequence
  Variant of Leucine Decarboxylase from Planctomycetaceae bacterium
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctcttttaccgttcctggcctatcccgtcaacaacgtgggcgatccgtttgctgcgtccagttatcgcgtgcatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaacattatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgcgccattaccgttgtgttcccgaaacctccgcagacggtgctggaaaagtggcaaatcgcaaccgagggcgacgatgcgcatatttgcttaatgccaagtaccacccgtcagcatgtcgatgaattgatcgctgacattgcggccgccaataaagcggctgcagcaccgagcgatacgcagaaacccgccgccaagaaacgcccgacaccggctggtgcaccgcaacgtactacg

SEQ ID NO: 318 - protein, 406 aa, Artificial Sequence
  Variant of Leucine Decarboxylase from Planctomycetaceae bacterium
MGNLKFPDGALSPTDRRRLEDVYQYVREQCDTFIGYPCNMHFDYTPLLPFLAYPVNNVGDPFAASSYRVHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKHYVERIARSIEYIGTLDTTISGSRNGITPLFLWYAVKQAGRDGFKRRVAACLDNARYTVEQFKRIGVEAMRNPCAITVVFPKPPQTVLEKWQIATEGDDAHICLMPSTTRQHVDELIADIAAANKAAAAPSDTQKPAAKKRPTPAGAPQRTT

SEQ ID NO: 319 - DNA, 1218 bp, Artificial Sequence
  Variant of Leucine Decarboxylase from Planctomycetaceae bacterium
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctcttttaccgttcctggcctatcccgtcaacaacgtgggcgatccgtttgctgcgtccagttatcgcgtgcatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaacattatgtggagcgtattgctcgcgttattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagcggctgcagcaccgagcgatacgcagaaacccgccgccaagaaacgcccgacaccggctggtgcaccgcaacgtactacg

SEQ ID NO: 320 - protein, 406 aa, Artificial Sequence
  Variant of Leucine Decarboxylase from Planctomycetaceae bacterium
MGNLKFPDGALSPTDRRRLEDVYQYVREQCDTFIGYPCNMHFDYTPLLPFLAYPVNNVGDPFAASSYRVHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKHYVERIARVIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTRQHVDELIADIAAANKAAAAPSDTQKPAAKKRPTPAGAPQRTT

SEQ ID NO: 321 - DNA, 1218 bp, Artificial Sequence
  Variant of Leucine Decarboxylase from Planctomycetaceae bacterium
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctcttttaccgttcctggcctatcccgtcaacaacgtgggcgatccgtttgctgcgtccagttatcgcgtgcatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaacattatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagcggctgcagcaccgagcgatacgcagaaagaggccgccaagaaacgcccgacaccggctggtgcaccgcaacgtactacg

SEQ ID NO: 322 - protein, 406 aa, Artificial Sequence
  Variant of Leucine Decarboxylase from Planctomycetaceae bacterium
MGNLKFPDGALSPTDRRRLEDVYQYVREQCDTFIGYPCNMHFDYTPLLPFLAYPVNNVGDPFAASSYRVHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKHYVERIARSIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTRQHVDELIADIAAANKAAAAPSDTQKEAAKKRPTPAGAPQRTT

SEQ ID NO: 323 - DNA, 1218 bp, Artificial Sequence
  Variant of Leucine Decarboxylase from Planctomycetaceae bacterium
atgggtatgctgaaatttccagatggcgcgttgagcccgaccgaccgccgccgtctggaagatgtgtatcagtacgttcgtgagcaatgcgacaccttcatcgggtatccgtgcaacatgcactttgattacacacctcttttaccgttcctggcctatcccgtcaacaacgtgggcgatccgtttgctgcgtccagttatcgcgtgcatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaacattatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagcggctgcagcaccgagcgatacgcagaaacccgccgccaagaaacgcccgacaccggctggtgcaccgcaacgtactacg

SEQ ID NO: 324 - protein, 406 aa, Artificial Sequence
  Variant of Leucine Decarboxylase from Planctomycetaceae bacterium
MGMLKFPDGALSPTDRRRLEDVYQYVREQCDTFIGYPCNMHFDYTPLLPFLAYPVNNVGDPFAASSYRVHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKHYVERIARSIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTRQHVDELIADIAAANKAAAAPSDTQKPAAKKRPTPAGAPQRTT

SEQ ID NO: 325 - DNA, 1218 bp, Artificial Sequence
  Variant of Leucine Decarboxylase from Planctomycetaceae bacterium
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctcttttaccgttcctggcctatcccgtcaacaacgtgggcgatccgtttgctgcgtccagttatcgcgtgcatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaacattatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagcggctgcagcaccgagcgatacgcagaaataggccgccaagaaacgcccgacaccggctggtgcaccgcaacgtactacg

SEQ ID NO: 326 - protein, 389 aa, Artificial Sequence
  Variant of Leucine Decarboxylase from Planctomycetaceae bacterium
MGNLKFPDGALSPTDRRRLEDVYQYVREQCDTFIGYPCNMHFDYTPLLPFLAYPVNNVGDPFAASSYRVHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKHYVERIARSIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTRQHVDELIADIAAANKAAAAPSDTQK

SEQ ID NO: 327 - DNA, 1218 bp, Artificial Sequence
  Variant of Leucine Decarboxylase from Planctomycetaceae bacterium
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctcttttaccgttcctggcctatcccgtcaacaacgtgggcgatccgtttgctgcgtccagttatcgcgtgcatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaacattatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagcggctgcagcaccgagcgatacgcagaaaagtgccgccaagaaacgcccgacaccggctggtgcaccgcaacgtactacg

SEQ ID NO: 328 - protein, 406 aa, Artificial Sequence
  Variant of Leucine Decarboxylase from Planctomycetaceae bacterium
MGNLKFPDGALSPTDRRRLEDVYQYVREQCDTFIGYPCNMHFDYTPLLPFLAYPVNNVGDPFAASSYRVHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKHYVERIARSIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTRQHVDELIADIAAANKAAAAPSDTQKSAAKKRPTPAGAPQRTT

SEQ ID NO: 329 - DNA, 1218 bp, Artificial Sequence
  Variant of Leucine Decarboxylase from Planctomycetaceae bacterium
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctcttttaccgttcctggcctatcccgtcaacaacgtgggcgatccgtttgctgcgtccagttatcgcgtgcatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaacattatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagcggctgcagcaccgagcgatacgcagaaacccgccgccaagaaacgcccgacaccggctggttagccgcaacgtactacg

SEQ ID NO: 330 - protein, 400 aa, Artificial Sequence
  Variant of Leucine Decarboxylase from Planctomycetaceae bacterium
MGNLKFPDGALSPTDRRRLEDVYQYVREQCDTFIGYPCNMHFDYTPLLPFLAYPVNNVGDPFAASSYRVHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKHYVERIARSIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTRQHVDELIADIAAANKAAAAPSDTQKPAAKKRPTPAG

SEQ ID NO: 331 - DNA, 1218 bp, Artificial Sequence
  Variant of Leucine Decarboxylase from Planctomycetaceae bacterium
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctcttttaccgttcctggcctatcccgtcaacaacgtgggcgatccgtttgctgcgtccagttatcgcgtgcatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaacattatgtggagcgtattgctcgcactattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagcggctgcagcaccgagcgatacgcagaaacccgccgccaagaaacgcccgacaccggctggtgcaccgcaacgtactacg

SEQ ID NO: 332 - protein, 406 aa, Artificial Sequence
  Variant of Leucine Decarboxylase from Planctomycetaceae bacterium
MGNLKFPDGALSPTDRRRLEDVYQYVREQCDTFIGYPCNMHFDYTPLLPFLAYPVNNVGDPFAASSYRVHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKHYVERIARTIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTRQHVDELIADIAAANKAAAAPSDTQKPAAKKRPTPAGAPQRTT

SEQ ID NO: 333 - DNA, 1218 bp, Artificial Sequence
  Variant of Leucine Decarboxylase from Planctomycetaceae bacterium
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctcttttaccgttcctggcctatcccgtcaacaacgtgggcgatccgtttgctgcgtccagttatcgcgtgcatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaacattatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagcggctgcagcaccgagcgatacgcagaaacccgccgccaagaaacgcccgacaccggctggttatccgcaacgtactacg

SEQ ID NO: 334 - protein, 406 aa, Artificial Sequence
  Variant of Leucine Decarboxylase from Planctomycetaceae bacterium
MGNLKFPDGALSPTDRRRLEDVYQYVREQCDTFIGYPCNMHFDYTPLLPFLAYPVNNVGDPFAASSYRVHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKHYVERIARSIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTRQHVDELIADIAAANKAAAAPSDTQKPAAKKRPTPAGYPQRTT

SEQ ID NO: 335 - DNA, 1218 bp, Artificial Sequence
  Variant of Leucine Decarboxylase from Planctomycetaceae bacterium
atgggtaatctgaaatttccagatggcgcgttgagcccgaccgaccgccgccgtctggaagatgtgtatcagtacgttcgtgagcaatgcgacaccctgatcgggtatccgtgcaacatgcactttgattacacacctcttttaccgttcctggcctatcccgtcaacaacgtgggcgatccgtttgctgcgtccagttatcgcgtgcatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaacattatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagcggctgcagcaccgagcgatacgcagaaacccgccgccaagaaacgcccgacaccggctggtgcaccgcaacgtactacg

SEQ ID NO: 336 - protein, 406 aa, Artificial Sequence
  Variant of Leucine Decarboxylase from Planctomycetaceae bacterium
MGNLKFPDGALSPTDRRRLEDVYQYVREQCDTLIGYPCNMHFDYTPLLPFLAYPVNNVGDPFAASSYRVHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKHYVERIARSIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTRQHVDELIADIAAANKAAAAPSDTQKPAAKKRPTPAGAPQRTT

SEQ ID NO: 337 - DNA, 1218 bp, Artificial Sequence
  Variant of Leucine Decarboxylase from Planctomycetaceae bacterium
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctcttttaccgttcctggcctatcccgtcaacaacgtgggcgatccgtttgctgcgtccagttatcgcgtgcatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaacattatgtggagttgattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagcggctgcagcaccgagcgatacgcagaaacccgccgccaagaaacgcccgacaccggctggtgcaccgcaacgtactacg

SEQ ID NO: 338 - protein, 406 aa, Artificial Sequence
  Variant of Leucine Decarboxylase from Planctomycetaceae bacterium
MGNLKFPDGALSPTDRRRLEDVYQYVREQCDTFIGYPCNMHFDYTPLLPFLAYPVNNVGDPFAASSYRVHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKHYVELIARSIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTRQHVDELIADIAAANKAAAAPSDTQKPAAKKRPTPAGAPQRTT

SEQ ID NO: 339 - DNA, 1218 bp, Artificial Sequence
  Variant of Leucine Decarboxylase from Planctomycetaceae bacterium
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctcttttaccgttcctggcctatcccgtcaacaacgtgggcgatccgtttgctgcgtccagttatcgcgtgcatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaacattatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagcggctgcagcaccgagcgatacgcagaagcccgccgccaagaaggacccggctccggctggtgcaccgcaacgtactacg

SEQ ID NO: 340 - protein, 406 aa, Artificial Sequence
  Variant of Leucine Decarboxylase from Planctomycetaceae bacterium
MGNLKFPDGALSPTDRRRLEDVYQYVREQCDTFIGYPCNMHFDYTPLLPFLAYPVNNVGDPFAASSYRVHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKHYVERIARSIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTRQHVDELIADIAAANKAAAAPSDTQKPAAKKDPAPAGAPQRTT

SEQ ID NO: 341 - DNA, 1218 bp, Artificial Sequence
  Variant of Leucine Decarboxylase from Planctomycetaceae bacterium
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctcttttaccgttcctggcctatcccgtcaacaacgtgggcgatccgtttgctgcgtccagttatcgcgtgcatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaacattatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagcggctgcagcaccgagcgatacgcagaaacccgccgccaaggagcgcccgactccggctggtgcaccgcaacgtactacg

SEQ ID NO: 342 - protein, 406 aa, Artificial Sequence
  Variant of Leucine Decarboxylase from Planctomycetaceae bacterium
MGNLKFPDGALSPTDRRRLEDVYQYVREQCDTFIGYPCNMHFDYTPLLPFLAYPVNNVGDPFAASSYRVHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKHYVERIARSIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTRQHVDELIADIAAANKAAAAPSDTQKPAAKERPTPAGAPQRTT

SEQ ID NO: 343 - DNA, 1218 bp, Artificial Sequence
  Variant of Leucine Decarboxylase from Planctomycetaceae bacterium
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctcttttaccgttcctggcctatcccgtcaacaacgtgggcgatccgtttgctgcgtccagttatcgcgtgcatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaacattatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagcggctgcagcaccgagcgatacgcagaagcccgccgccaagaagcgcccggctccggctggtgcaccgcaacgtactacg

SEQ ID NO: 344 - protein, 406 aa, Artificial Sequence
  Variant of Leucine Decarboxylase from Planctomycetaceae bacterium
MGNLKFPDGALSPTDRRRLEDVYQYVREQCDTFIGYPCNMHFDYTPLLPFLAYPVNNVGDPFAASSYRVHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKHYVERIARSIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTRQHVDELIADIAAANKAAAAPSDTQKPAAKKRPAPAGAPQRTT

SEQ ID NO: 345 - DNA, 1218 bp, Artificial Sequence
  Variant of Leucine Decarboxylase from Planctomycetaceae bacterium
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctcttttaccgttcctggcctatcccgtcaacaacgtgggcgatccgtttgctgcgtccagttatcgcgtgcatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaacattatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagcggctgcagcaccgagcgatacgcagaagcccgccgccaagaagaagccgactccggctggtgcaccgcaacgtactacg

SEQ ID NO: 346 - protein, 406 aa, Artificial Sequence
  Variant of Leucine Decarboxylase from Planctomycetaceae bacterium
MGNLKFPDGALSPTDRRRLEDVYQYVREQCDTFIGYPCNMHFDYTPLLPFLAYPVNNVGDPFAASSYRVHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKHYVERIARSIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTRQHVDELIADIAAANKAAAAPSDTQKPAAKKKPTPAGAPQRTT

SEQ ID NO: 347 - DNA, 1218 bp, Artificial Sequence
  Variant of Leucine Decarboxylase from Planctomycetaceae bacterium
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctcttttaccgttcctggcctatcccgtcaacaacgtgggcgatccgtttgctgcgtccagttatcgcgtgcatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaacattatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgaaccgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagcggctgcagcaccgagcgatacgcagaagcccgccgccaaggagaagccggctccggctggtgcaccgcaacgtactacg

SEQ ID NO: 348 - protein, 406 aa, Artificial Sequence
  Variant of Leucine Decarboxylase from Planctomycetaceae bacterium
MGNLKFPDGALSPTDRRRLEDVYQYVREQCDTFIGYPCNMHFDYTPLLPFLAYPVNNVGDPFAASSYRVHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKHYVERIARSIEYIGTLDTTISGSRNGITPLFLWYAVKQAGRDGFKRRVAACLDNARYTVEQFKRIGVEANRNPCAITVVFPKPPQSVLEKWQIATEGDDAHICLMPSTTRQHVDELIADIAAANKAAAAPSDTQKPAAKEKPAPAGAPQRTT

SEQ ID NO: 349 - DNA, 1218 bp, Artificial Sequence
  Variant of Leucine Decarboxylase from Planctomycetaceae bacterium
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctcttttaccgttcctggcctatcccgtcaacaacgtgggcgatccgtttgctgcgtccagttatcgcgtgcatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaacattatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagcggctgcagcaccgagcgatacgcagggccccgccgccaagaagcgcccgactccggctggtgcaccgcaacgtactacg

SEQ ID NO: 350 - protein, 406 aa, Artificial Sequence
  Variant of Leucine Decarboxylase from Planctomycetaceae bacterium
MGNLKFPDGALSPTDRRRLEDVYQYVREQCDTFIGYPCNMHFDYTPLLPFLAYPVNNVGDPFAASSYRVHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKHYVERIARSIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTRQHVDELIADIAAANKAAAAPSDTQGPAAKKRPTPAGAPQRTT

SEQ ID NO: 351 - DNA, 1218 bp, Artificial Sequence
  Variant of Leucine Decarboxylase from Planctomycetaceae bacterium
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctcttttaccgttcctggcctatcccgtcaacaacgtgggcgatccgtttgctgcgtccagttatcgcgtgcatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaacattatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagcggctgcagcaccgagcgatacgcagggccccgccgccaaggaggacccgactccggctggtgcaccgcaacgtactacg

SEQ ID NO: 352 - protein, 406 aa, Artificial Sequence
  Variant of Leucine Decarboxylase from Planctomycetaceae bacterium
MGNLKFPDGALSPTDRRRLEDVYQYVREQCDTFIGYPCNMHFDYTPLLPFLAYPVNNVGDPFAASSYRVHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKHYVERIARSIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTRQHVDELIADIAAANKAAAAPSDTQGPAAKEDPTPAGAPQRTT

SEQ ID NO: 353 - DNA, 1218 bp, Artificial Sequence
  Variant of Leucine Decarboxylase from Planctomycetaceae bacterium
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctcttttaccgttcctggcctatcccgtcaacaacgtgggcgatccgtttgctgcgtccagttatcgcgtgcatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaacattatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagcggctgcagcaccgagcgatacgcagggccccgccgccaaggaggacccggctccggctggtgcaccgcaacgtactacg

SEQ ID NO: 354 - protein, 406 aa, Artificial Sequence
  Variant of Leucine Decarboxylase from Planctomycetaceae bacterium
MGNLKFPDGALSPTDRRRLEDVYQYVREQCDTFIGYPCNMHFDYTPLLPFLAYPVNNVGDPFAASSYRVHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKHYVERIARSIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTRQHVDELIADIAAANKAAAAPSDTQGPAAKEDPAPAGAPQRTT

SEQ ID NO: 355 - DNA, 1218 bp, Artificial Sequence
  Variant of Leucine Decarboxylase from Planctomycetaceae bacterium
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctcttttaccgttcctggcctatcccgtcaacaacgtgggcgatccgtttgctgcgtccagttatcgcgtgcatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaacattatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgagccgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagcggctgcagcaccgagcgatacgcagaagcccgccgccaaggagaagccgactccggctggtgcaccgcaacgtactacg

SEQ ID NO: 356 - protein, 406 aa, Artificial Sequence
  Variant of Leucine Decarboxylase from Planctomycetaceae bacterium
MGNLKFPDGALSPTDRRRLEDVYQYVREQCDTFIGYPCNMHFDYTPLLPFLAYPVNNVGDPFAASSYRVHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKHYVERIARSIEYIGTLDTTISGSRNGITPLFLWYAVKQAGRDGFKRRVAACLDNARYTVEQFKRIGVEASRNPCAITVVFPKPPQSVLEKWQIATEGDDAHICLMPSTTRQHVDELIADIAAANKAAAAPSDTQKPAAKEKPTPAGAPQRTT

SEQ ID NO: 357 - DNA, 1218 bp, Artificial Sequence
  Variant of Leucine Decarboxylase from Planctomycetaceae bacterium
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctcttttaccgttcctggcctatcccgtcaacaacgtgggcgatccgtttgctgcgtccagttatcgcgtgcatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaacattatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgagccgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagcggctgcagcaccgagcgatacgcagggccccgccgccaaggaggacccgactccggctggtgcaccgcaacgtactacg

SEQ ID NO: 358 - protein, 406 aa, Artificial Sequence
  Variant of Leucine Decarboxylase from Planctomycetaceae bacterium
MGNLKFPDGALSPTDRRRLEDVYQYVREQCDTFIGYPCNMHFDYTPLLPFLAYPVNNVGDPFAASSYRVHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKHYVERIARSIEYIGTLDTTISGSRNGITPLFLWYAVKQAGRDGFKRRVAACLDNARYTVEQFKRIGVEASRNPCAITVVFPKPPQSVLEKWQIATEGDDAHICLMPSTTRQHVDELIADIAAANKAAAAPSDTQGPAAKEDPTPAGAPQRTT

SEQ ID NO: 359 - DNA, 1218 bp, Artificial Sequence
  Variant of Leucine Decarboxylase from Planctomycetaceae bacterium
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctcttttaccgttcctggcctatcccgtcaacaacgtgggcgatccgtttgctgcgtccagttatcgcgtgcatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaacattatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagcggctgcagcaccgagcgatacgcagaagcccgccgccaaggaggacccgactccggctggtgcaccgcaacgtactacg

SEQ ID NO: 360 - protein, 406 aa, Artificial Sequence
  Variant of Leucine Decarboxylase from Planctomycetaceae bacterium
MGNLKFPDGALSPTDRRRLEDVYQYVREQCDTFIGYPCNMHFDYTPLLPFLAYPVNNVGDPFAASSYRVHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKHYVERIARSIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTRQHVDELIADIAAANKAAAAPSDTQKPAAKEDPTPAGAPQRTT

SEQ ID NO: 361 - DNA, 1218 bp, Artificial Sequence
  Variant of Leucine Decarboxylase from Planctomycetaceae bacterium
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctcttttaccgttcctggcctatcccgtcaacaacgtgggcgatccgtttgctgcgtccagttatcgcgtgcatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaacattatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgagccgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagcggctgcagcaccgagcgatacgcagaagcccgccgccaaggagcgcccgactccggctggtgcaccgcaacgtactacg

SEQ ID NO: 362 - protein, 406 aa, Artificial Sequence
  Variant of Leucine Decarboxylase from Planctomycetaceae bacterium
MGNLKFPDGALSPTDRRRLEDVYQYVREQCDTFIGYPCNMHFDYTPLLPFLAYPVNNVGDPFAASSYRVHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKHYVERIARSIEYIGTLDTTISGSRNGITPLFLWYAVKQAGRDGFKRRVAACLDNARYTVEQFKRIGVEASRNPCAITVVFPKPPQSVLEKWQIATEGDDAHICLMPSTTRQHVDELIADIAAANKAAAAPSDTQKPAAKERPTPAGAPQRTT

SEQ ID NO: 363 - DNA, 1218 bp, Artificial Sequence
  Variant of Leucine Decarboxylase from Planctomycetaceae bacterium
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctcttttaccgttcctggcctatcccgtcaacaacgtgggcgatccgtttgctgcgtccagttatcgcgtgcatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaacattatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgaaccgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagcggctgcagcaccgagcgatacgcagaagcccgccgccaagaaggacccgactccggctggtgcaccgcaacgtactacg

SEQ ID NO: 364 - protein, 406 aa, Artificial Sequence
  Variant of Leucine Decarboxylase from Planctomycetaceae bacterium
MGNLKFPDGALSPTDRRRLEDVYQYVREQCDTFIGYPCNMHFDYTPLLPFLAYPVNNVGDPFAASSYRVHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKHYVERIARSIEYIGTLDTTISGSRNGITPLFLWYAVKQAGRDGFKRRVAACLDNARYTVEQFKRIGVEANRNPCAITVVFPKPPQSVLEKWQIATEGDDAHICLMPSTTRQHVDELIADIAAANKAAAAPSDTQKPAAKKDPTPAGAPQRTT

SEQ ID NO: 365 - DNA, 1218 bp, Artificial Sequence
  Variant of Leucine Decarboxylase from Planctomycetaceae bacterium
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctcttttaccgttcctggcctatcccgtcaacaacgtgggcgatccgtttgctgcgtccagttatcgcgtgcatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaacattatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagcggctgcagcaccgagcgatacgcagggccccgccgccaaggagcgcccgactccggctggtgcaccgcaacgtactacg

SEQ ID NO: 366 - protein, 406 aa, Artificial Sequence
  Variant of Leucine Decarboxylase from Planctomycetaceae bacterium
MGNLKFPDGALSPTDRRRLEDVYQYVREQCDTFIGYPCNMHFDYTPLLPFLAYPVNNVGDPFAASSYRVHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKHYVERIARSIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTRQHVDELIADIAAANKAAAAPSDTQGPAAKERPTPAGAPQRTT

SEQ ID NO: 367 - DNA, 1218 bp, Artificial Sequence
  Variant of Leucine Decarboxylase from Planctomycetaceae bacterium
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctcttttaccgttcctggcctatcccgtcaacaacgtgggcgatccgtttgctgcgtccagttatcgcgtgcatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaacattatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagcggctgcagcaccgagcgatacgcagggccccgccgccaagaaggacccgactccggctggtgcaccgcaacgtactacg

SEQ ID NO: 368 - protein, 406 aa, Artificial Sequence
  Variant of Leucine Decarboxylase from Planctomycetaceae bacterium
MGNLKFPDGALSPTDRRRLEDVYQYVREQCDTFIGYPCNMHFDYTPLLPFLAYPVNNVGDPFAASSYRVHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKHYVERIARSIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTRQHVDELIADIAAANKAAAAPSDTQGPAAKKDPTPAGAPQRTT

SEQ ID NO: 369 - DNA, 1218 bp, Artificial Sequence
  Variant of Leucine Decarboxylase from Planctomycetaceae bacterium
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctcttttaccgttcctggcctatcccgtcaacaacgtgggcgatccgtttgctgcgtccagttatcgcgtgcatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaacattatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgagccgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagcggctgcagcaccgagcgatacgcagaagcccgccgccaagaagaagccgactccggctggtgcaccgcaacgtactacg

SEQ ID NO: 370 - protein, 406 aa, Artificial Sequence
  Variant of Leucine Decarboxylase from Planctomycetaceae bacterium
MGNLKFPDGALSPTDRRRLEDVYQYVREQCDTFIGYPCNMHFDYTPLLPFLAYPVNNVGDPFAASSYRVHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKHYVERIARSIEYIGTLDTTISGSRNGITPLFLWYAVKQAGRDGFKRRVAACLDNARYTVEQFKRIGVEASRNPCAITVVFPKPPQSVLEKWQIATEGDDAHICLMPSTTRQHVDELIADIAAANKAAAAPSDTQKPAAKKKPTPAGAPQRTT

SEQ ID NO: 371 - DNA, 1218 bp, Artificial Sequence
  Variant of Leucine Decarboxylase from Planctomycetaceae bacterium
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctcttttaccgttcctggcctatcccgtcaacaacgtgggcgatccgtttgctgcgtccagttatcgcgtgcatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaacattatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgagccgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagcggctgcagcaccgagcgatacgcagaagcccgccgccaaggagaagccggctccggctggtgcaccgcaacgtactacg

SEQ ID NO: 372 - protein, 406 aa, Artificial Sequence
  Variant of Leucine Decarboxylase from Planctomycetaceae bacterium
MGNLKFPDGALSPTDRRRLEDVYQYVREQCDTFIGYPCNMHFDYTPLLPFLAYPVNNVGDPFAASSYRVHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKHYVERIARSIEYIGTLDTTISGSRNGITPLFLWYAVKQAGRDGFKRRVAACLDNARYTVEQFKRIGVEASRNPCAITVVFPKPPQSVLEKWQIATEGDDAHICLMPSTTRQHVDELIADIAAANKAAAAPSDTQKPAAKEKPAPAGAPQRTT

SEQ ID NO: 373 - DNA, 1218 bp, Artificial Sequence
  Variant of Leucine Decarboxylase from Planctomycetaceae bacterium
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctcttttaccgttcctggcctatcccgtcaacaacgtgggcgatccgtttgctgcgtccagttatcgcgtgcatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaacattatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagcggctgcagcaccgagcgatacgcagggccccgccgccaaggagaagccggctccggctggtgcaccgcaacgtactacg

SEQ ID NO: 374 - protein, 406 aa, Artificial Sequence
  Variant of Leucine Decarboxylase from Planctomycetaceae bacterium
MGNLKFPDGALSPTDRRRLEDVYQYVREQCDTFIGYPCNMHFDYTPLLPFLAYPVNNVGDPFAASSYRVHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKHYVERIARSIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTRQHVDELIADIAAANKAAAAPSDTQGPAAKEKPAPAGAPQRTT

SEQ ID NO: 375 - DNA, 1218 bp, Artificial Sequence
  Variant of Leucine Decarboxylase from Planctomycetaceae bacterium
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctcttttaccgttcctggcctatcccgtcaacaacgtgggcgatccgtttgctgcgtccagttatcgcgtgcatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaacattatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgagccgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagcggctgcagcaccgagcgatacgcagggccccgccgccaaggagcgcccgactccggctggtgcaccgcaacgtactacg

SEQ ID NO: 376 - protein, 406 aa, Artificial Sequence
  Variant of Leucine Decarboxylase from Planctomycetaceae bacterium
MGNLKFPDGALSPTDRRRLEDVYQYVREQCDTFIGYPCNMHFDYTPLLPFLAYPVNNVGDPFAASSYRVHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKHYVERIARSIEYIGTLDTTISGSRNGITPLFLWYAVKQAGRDGFKRRVAACLDNARYTVEQFKRIGVEASRNPCAITVVFPKPPQSVLEKWQIATEGDDAHICLMPSTTRQHVDELIADIAAANKAAAAPSDTQGPAAKERPTPAGAPQRTT

SEQ ID NO: 377 - DNA, 1218 bp, Artificial Sequence
  Variant of Leucine Decarboxylase from Planctomycetaceae bacterium
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctcttttaccgttcctggcctatcccgtcaacaacgtgggcgatccgtttgctgcgtccagttatcgcgtgcatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaacattatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagcggctgcagcaccgagcgatacgcagggccccgccgccaagaagaagccgactccggctggtgcaccgcaacgtactacg

SEQ ID NO: 378 - protein, 406 aa, Artificial Sequence
  Variant of Leucine Decarboxylase from Planctomycetaceae bacterium
MGNLKFPDGALSPTDRRRLEDVYQYVREQCDTFIGYPCNMHFDYTPLLPFLAYPVNNVGDPFAASSYRVHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKHYVERIARSIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTRQHVDELIADIAAANKAAAAPSDTQGPAAKKKPTPAGAPQRTT

SEQ ID NO: 379 - DNA, 1218 bp, Artificial Sequence
  Variant of Leucine Decarboxylase from Planctomycetaceae bacterium
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctcttttaccgttcctggcctatcccgtcaacaacgtgggcgatccgtttgctgcgtccagttatcgcgtgcatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaacattatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagcggctgcagcaccgagcgatacgcagggccccgccgccaagaagcgcccggctccggctggtgcaccgcaacgtactacg

SEQ ID NO: 380 - protein, 406 aa, Artificial Sequence
  Variant of Leucine Decarboxylase from Planctomycetaceae bacterium
MGNLKFPDGALSPTDRRRLEDVYQYVREQCDTFIGYPCNMHFDYTPLLPFLAYPVNNVGDPFAASSYRVHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKHYVERIARSIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTRQHVDELIADIAAANKAAAAPSDTQGPAAKKRPAPAGAPQRTT

SEQ ID NO: 381 - DNA, 1218 bp, Artificial Sequence
  Variant of Leucine Decarboxylase from Planctomycetaceae bacterium
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctcttttaccgttcctggcctatcccgtcaacaacgtgggcgatccgtttgctgcgtccagttatcgcgtgcatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaacattatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagcggctgcagcaccgagcgatacgcagggccccgccgccaaggagaagccgactccggctggtgcaccgcaacgtactacg

SEQ ID NO: 382 - protein, 406 aa, Artificial Sequence
  Variant of Leucine Decarboxylase from Planctomycetaceae bacterium
MGNLKFPDGALSPTDRRRLEDVYQYVREQCDTFIGYPCNMHFDYTPLLPFLAYPVNNVGDPFAASSYRVHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKHYVERIARSIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTRQHVDELIADIAAANKAAAAPSDTQGPAAKEKPTPAGAPQRTT

SEQ ID NO: 383 - DNA, 1218 bp, Artificial Sequence
  Variant of Leucine Decarboxylase from Planctomycetaceae bacterium
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctcttttaccgttcctggcctatcccgtcaacaacgtgggcgatccgtttgctgcgtccagttatcgcgtgcatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaacattatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgaaccgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagcggctgcagcaccgagcgatacgcagaagcccgccgccaagaaacgcccgacaccggctggtgcaccgcaacgtactacg

SEQ ID NO: 384 - protein, 406 aa, Artificial Sequence
  Variant of Leucine Decarboxylase from Planctomycetaceae bacterium
MGNLKFPDGALSPTDRRRLEDVYQYVREQCDTFIGYPCNMHFDYTPLLPFLAYPVNNVGDPFAASSYRVHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKHYVERIARSIEYIGTLDTTISGSRNGITPLFLWYAVKQAGRDGFKRRVAACLDNARYTVEQFKRIGVEANRNPCAITVVFPKPPQSVLEKWQIATEGDDAHICLMPSTTRQHVDELIADIAAANKAAAAPSDTQKPAAKKRPTPAGAPQRTT

SEQ ID NO: 385 - DNA, 1218 bp, Artificial Sequence
  Variant of Leucine Decarboxylase from Planctomycetaceae bacterium
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctcttttaccgttcctggcctatcccgtcaacaacgtgggcgatccgtttgctgcgtccagttatcgcgtgcatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaacattatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagcggctgcagcaccgagcgatacgcagggccccgccgccaaggagcgcccggctccggctggtgcaccgcaacgtactacg

SEQ ID NO: 386 - protein, 406 aa, Artificial Sequence
  Variant of Leucine Decarboxylase from Planctomycetaceae bacterium
MGNLKFPDGALSPTDRRRLEDVYQYVREQCDTFIGYPCNMHFDYTPLLPFLAYPVNNVGDPFAASSYRVHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKHYVERIARSIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTRQHVDELIADIAAANKAAAAPSDTQGPAAKERPAPAGAPQRTT

SEQ ID NO: 387 - DNA, 1218 bp, Artificial Sequence
  Variant of Leucine Decarboxylase from Planctomycetaceae bacterium
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctcttttaccgttcctggcctatcccgtcaacaacgtgggcgatccgtttgctgcgtccagttatcgcgtgcatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaacattatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgagccgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagcggctgcagcaccgagcgatacgcagggccccgccgccaaggagcgcccggctccggctggtgcaccgcaacgtactacg

SEQ ID NO: 388 - protein, 406 aa, Artificial Sequence
  Variant of Leucine Decarboxylase from Planctomycetaceae bacterium
MGNLKFPDGALSPTDRRRLEDVYQYVREQCDTFIGYPCNMHFDYTPLLPFLAYPVNNVGDPFAASSYRVHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKHYVERIARSIEYIGTLDTTISGSRNGITPLFLWYAVKQAGRDGFKRRVAACLDNARYTVEQFKRIGVEASRNPCAITVVFPKPPQSVLEKWQIATEGDDAHICLMPSTTRQHVDELIADIAAANKAAAAPSDTQGPAAKERPAPAGAPQRTT

SEQ ID NO: 389 - DNA, 1218 bp, Artificial Sequence
  Variant of Leucine Decarboxylase from Planctomycetaceae bacterium
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctcttttaccgttcctggcctatcccgtcaacaacgtgggcgatccgtttgctgcgtccagttatcgcgtgcatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaacattatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagcggctgcagcaccgagcgatacgcagaagcccgccgccaaggagaagccggctccggctggtgcaccgcaacgtactacg

SEQ ID NO: 390 - protein, 406 aa, Artificial Sequence
  Variant of Leucine Decarboxylase from Planctomycetaceae bacterium
MGNLKFPDGALSPTDRRRLEDVYQYVREQCDTFIGYPCNMHFDYTPLLPFLAYPVNNVGDPFAASSYRVHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKHYVERIARSIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTRQHVDELIADIAAANKAAAAPSDTQKPAAKEKPAPAGAPQRTT

SEQ ID NO: 391 - DNA, 1221 bp, Artificial Sequence
  Variant of Leucine Decarboxylase from Planctomycetaceae bacterium
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctagctccagttatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgagccgtaatccatgcgccattaccgttgtgttcccgaaacctccggcgtcagtgctggaaaagtggcaaatcgcaaccgagggcgacgatgcgcatatttgcttaatgccaagtaccacccgtcagcatgtcgatgaattgatcgctgacattgcggccgccaataaagaagctgcggcaccgagcgatacgcagggttgagccgccaagaaacgcccgacaccggctggtgcaccgcaacgtactacgtag

SEQ ID NO: 392 - protein, 389 aa, Artificial Sequence
  Variant of Leucine Decarboxylase from Planctomycetaceae bacterium
MGNLKFPDGALSPTDRRRLEDVYQYVREQCDTFIGYPCNMHFDYTPLFPFLAYPVNNVGDPFASSSYRIHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKPYVERIARSIEYIGTLDTTISGSRNGITPLFLWYAVKQAGRDGFKRRVAACLDNARYTVEQFKRIGVEASRNPCAITVVFPKPPASVLEKWQIATEGDDAHICLMPSTTRQHVDELIADIAAANKEAAAPSDTQG

SEQ ID NO: 393 - DNA, 1221 bp, Artificial Sequence
  Variant of Leucine Decarboxylase from Planctomycetaceae bacterium
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctgagtccagttatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagcgtattgctcgcactattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagcagctgcggcaccgagcgatacgcagggttgagccgccaagaaacgcccgacaccggctggtgcaccgcaacgtactacgtag

SEQ ID NO: 394 - protein, 389 aa, Artificial Sequence
  Variant of Leucine Decarboxylase from Planctomycetaceae bacterium
MGNLKFPDGALSPTDRRRLEDVYQYVREQCDTFIGYPCNMHFDYTPLFPFLAYPVNNVGDPFAESSYRIHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKPYVERIARTIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTRQHVDELIADIAAANKAAAAPSDTQG

SEQ ID NO: 395 - DNA, 1218 bp, Artificial Sequence
  Variant of Leucine Decarboxylase from Planctomycetaceae bacterium
atggggaatctgaaatttccagatggcgcgttgagcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctagctccagttatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgcgccattaccgttgtgttcccgaaacctccggcgtcagtgctggaaaagtggcaaatcgcaaccgagggcgacgatgcgcatatttgcttaatgccaagtaccacccgtcagcatgtcgatgaattgatcgctgacattgcggccgccaataaagcggctgcagcaccgagcgatacgcagggttgagccgccaagaaacgcccgacaccggctggtgcaccgcaacgtactacg

SEQ ID NO: 396 - protein, 389 aa, Artificial Sequence
  Variant of Leucine Decarboxylase from Planctomycetaceae bacterium
MGNLKFPDGALSPTDRRRLEDVYQYVREQCDTFIGYPCNMHFDYTPLFPFLAYPVNNVGDPFASSSYRIHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKPYVERIARSIEYIGTLDTTISGSRNGITPLFLWYAVKQAGRDGFKRRVAACLDNARYTVEQFKRIGVEAMRNPCAITVVFPKPPASVLEKWQIATEGDDAHICLMPSTTRQHVDELIADIAAANKAAAAPSDTQG

SEQ ID NO: 397 - DNA, 1221 bp, Artificial Sequence
  Variant of Leucine Decarboxylase from Planctomycetaceae bacterium
atggggatgctgaaatttccagatggcgcgttgagcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctagctccagttatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagcgtattgctcgcactattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgcgccattaccgttgtgttcccgaaacctccggcgtcagtgctggaaaagtggcaaatcgcaaccgagggcgacgatgcgcatatttgcttaatgccaagtaccacccgtcagcatgtcgatgaattgatcgctgacattgcggccgccaataaagaagctgcggcaccgagcgatacggccaagcccgccgccaagaaacgcccgacaccggctggtgcaccgcaacgtactacgtag

SEQ ID NO: 398 - protein, 406 aa, Artificial Sequence
  Variant of Leucine Decarboxylase from Planctomycetaceae bacterium
MGMLKFPDGALSPTDRRRLEDVYQYVREQCDTFIGYPCNMHFDYTPLFPFLAYPVNNVGDPFASSSYRIHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKPYVERIARTIEYIGTLDTTISGSRNGITPLFLWYAVKQAGRDGFKRRVAACLDNARYTVEQFKRIGVEAMRNPCAITVVFPKPPASVLEKWQIATEGDDAHICLMPSTTRQHVDELIADIAAANKEAAAPSDTAKPAAKKRPTPAGAPQRTT

SEQ ID NO: 399 - DNA, 1221 bp, Artificial Sequence
  Variant of Leucine Decarboxylase from Planctomycetaceae bacterium
atggggatgctgaaatttccagatggcgcgttgagcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctgagtccagttatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgagccgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagaagcttcggcaccgagcgatacgcagggttgagccgccaagaaacgcccgacaccggctggtgcaccgcaacgtactacgtag

SEQ ID NO: 400 - protein, 389 aa, Artificial Sequence
  Variant of Leucine Decarboxylase from Planctomycetaceae bacterium
MGMLKFPDGALSPTDRRRLEDVYQYVREQCDTFIGYPCNMHFDYTPLFPFLAYPVNNVGDPFAESSYRIHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKPYVERIARSIEYIGTLDTTISGSRNGITPLFLWYAVKQAGRDGFKRRVAACLDNARYTVEQFKRIGVEASRNPCAITVVFPKPPQSVLEKWQIATEGDDAHICLMPSTTRQHVDELIADIAAANKEASAPSDTQG

SEQ ID NO: 401 - DNA, 1221 bp, Artificial Sequence
  Variant of Leucine Decarboxylase from Planctomycetaceae bacterium
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctgagtccagttatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgcgccattaccgttgtgttcccgaaacctccggcgtcagtgctggaaaagtggcaaatcgcaaccgagggcgacgatgcgcatatttgcttaatgccaagtaccacccgtcagcatgtcgatgaattgatcgctgacattgcggccgccaataaagcagctgcggcaccgagcgatacgcagaagtgagccgccaagaaacgcccgacaccggctggtgcaccgcaacgtactacgtag

SEQ ID NO: 402 - protein, 389 aa, Artificial Sequence
  Variant of Leucine Decarboxylase from Planctomycetaceae bacterium
MGNLKFPDGALSPTDRRRLEDVYQYVREQCDTFIGYPCNMHFDYTPLFPFLAYPVNNVGDPFAESSYRIHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKPYVERIARSIEYIGTLDTTISGSRNGITPLFLWYAVKQAGRDGFKRRVAACLDNARYTVEQFKRIGVEAMRNPCAITVVFPKPPASVLEKWQIATEGDDAHICLMPSTTRQHVDELIADIAAANKAAAAPSDTQK

SEQ ID NO: 403 - DNA, 1221 bp, Artificial Sequence
  Variant of Leucine Decarboxylase from Planctomycetaceae bacterium
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctgaatccagttatcgcgtgcatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagcgtattgctcgcactattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagcggctgcggcaccgagcgatacgcagaagtgagccgccaagaaacgcccgacaccggctggtgcaccgcaacgtactacgtag

SEQ ID NO: 404 - protein, 389 aa, Artificial Sequence
  Variant of Leucine Decarboxylase from Planctomycetaceae bacterium
MGNLKFPDGALSPTDRRRLEDVYQYVREQCDTFIGYPCNMHFDYTPLFPFLAYPVNNVGDPFAESSYRVHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKPYVERIARTIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTRQHVDELIADIAAANKAAAAPSDTQK

SEQ ID NO: 405 - DNA, 1221 bp, Artificial Sequence
  Variant of Leucine Decarboxylase from Planctomycetaceae bacterium
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctagctccagttatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagcggctgcagcaccgagcgatacgcagggtcccgccgccaagaaacgcccgacaccggctggtgcaccgcaacgtactacgtag

SEQ ID NO: 406 - protein, 406 aa, Artificial Sequence
  Variant of Leucine Decarboxylase from Planctomycetaceae bacterium
MGNLKFPDGALSPTDRRRLEDVYQYVREQCDTFIGYPCNMHFDYTPLFPFLAYPVNNVGDPFASSSYRIHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKPYVERIARSIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTRQHVDELIADIAAANKAAAAPSDTQGPAAKKRPTPAGAPQRTT

SEQ ID NO: 407 - DNA, 1221 bp, Artificial Sequence
  Variant of Leucine Decarboxylase from Planctomycetaceae bacterium
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctgagtccagttatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagcgtattgctcgcactattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagcggctgcagcaccgagcgatacgcagaagcccgccgccaagaaacgcccgacaccggctggtgcaccgcaacgtactacgtag

SEQ ID NO: 408 - protein, 406 aa, Artificial Sequence
  Variant of Leucine Decarboxylase from Planctomycetaceae bacterium
MGNLKFPDGALSPTDRRRLEDVYQYVREQCDTFIGYPCNMHFDYTPLFPFLAYPVNNVGDPFAESSYRIHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKPYVERIARTIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTRQHVDELIADIAAANKAAAAPSDTQKPAAKKRPTPAGAPQRTT

SEQ ID NO: 409 - DNA, 1221 bp, Artificial Sequence; identical to SEQ ID NO: 233
  Variant of Leucine Decarboxylase from Planctomycetaceae bacterium

SEQ ID NO: 410 - protein, 406 aa, Artificial Sequence; identical to SEQ ID NO: 234
  Variant of Leucine Decarboxylase from Planctomycetaceae bacterium

SEQ ID NO: 411 - DNA, 1221 bp, Artificial Sequence
  Variant of Leucine Decarboxylase from Planctomycetaceae bacterium
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctgagtccagttatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccaatgtttgactttgccactggcattgattcgcttagcatctccggtcacaaattcattgggtctccgatgccttgcggcatcgttttgacacgcaaaccttatgtggagcgtattgctcgcactattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgagccgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagcagcttcggcaccgagcgatacggccaagtgagccgccaagaaacgcccgacaccggctggtgcaccgcaacgtactacgtag

SEQ ID NO: 412 - protein, 389 aa, Artificial Sequence
  Variant of Leucine Decarboxylase from Planctomycetaceae bacterium
MGNLKFPDGALSPTDRRRLEDVYQYVREQCDTFIGYPCNMHFDYTPLFPFLAYPVNNVGDPFAESSYRIHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPMFDFATGIDSLSISGHKFIGSPMPCGIVLTRKPYVERIARTIEYIGTLDTTISGSRNGITPLFLWYAVKQAGRDGFKRRVAACLDNARYTVEQFKRIGVEASRNPCAITVVFPKPPQSVLEKWQIATEGDDAHICLMPSTTRQHVDELIADIAAANKAASAPSDTAK

SEQ ID NO: 413 - DNA, 1221 bp, Artificial Sequence
  Variant of Leucine Decarboxylase from Planctomycetaceae bacterium
atggggaacctgaaatttccagatggcgcgttgagcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctgagtccagttatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgagccgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaatgacgaagctgcggcaccgagcgatacggccaagcccgccgccaagaaacgcccgacaccggctggtgcaccgcaacgtactacgtag

SEQ ID NO: 414 - protein, 406 aa, Artificial Sequence
  Variant of Leucine Decarboxylase from Planctomycetaceae bacterium
MGNLKFPDGALSPTDRRRLEDVYQYVREQCDTFIGYPCNMHFDYTPLFPFLAYPVNNVGDPFAESSYRIHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKPYVERIARSIEYIGTLDTTISGSRNGITPLFLWYAVKQAGRDGFKRRVAACLDNARYTVEQFKRIGVEASRNPCAITVVFPKPPQSVLEKWQIATEGDDAHICLMPSTTRQHVDELIADIAAANDEAAAPSDTAKPAAKKRPTPAGAPQRTT

SEQ ID NO: 415 - DNA, 1218 bp, Artificial Sequence
  Variant of Leucine Decarboxylase from Planctomycetaceae bacterium
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctagctccagttatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcgccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagcagattgctcgcacgattgaatatatcggtaccctggacactacgatttcgggcagccgtaatggtattacaccgctgtttctttggtacgcggtgaaacaagctggacgcgatggcttcaaacgtcgtgttgcgcgttgtctggataacgcccgctatacggtcgagcagtttaaacgcatcggtgtagaagcgatgcgtaatccatgcgccattaccgttgtgttcccgaaacctccggctactgtgctggaaaagtggcaaatcgcaaccgagggcgacgatgcgcatatttgcttaatgccaagtaccacccgtcagcatgtcgatgaattgatcgctgacattgcggccgccaataatgcggctgccgcaccgagcgatacgcagaaacccgccgccaagaaacgcccgacaccggctggtgcaccgcaacgtactacg

SEQ ID NO: 416 - protein, 406 aa, Artificial Sequence
  Variant of Leucine Decarboxylase from Planctomycetaceae bacterium
MGNLKFPDGALSPTDRRRLEDVYQYVREQCDTFIGYPCNMHFDYTPLFPFLAYPVNNVGDPFASSSYRIHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRAIQDMFKKLAIHESHIHCDAALAGMTLPFMDDAPAFDFATGIDSLSISGHKFIGSPMPCGIVLTRKPYVEQIARTIEYIGTLDTTISGSRNGITPLFLWYAVKQAGRDGFKRRVARCLDNARYTVEQFKRIGVEAMRNPCAITVVFPKPPATVLEKWQIATEGDDAHICLMPSTTRQHVDELIADIAAANNAAAAPSDTQKPAAKKRPTPAGAPQRTT

SEQ ID NO: 417 - DNA, 1221 bp, Artificial Sequence
  Variant of Leucine Decarboxylase from Planctomycetaceae bacterium
atggggaacctgaaatttccagatggcgcgttgagcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctgagtccagttatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagcgtattgctcgcactattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgcgccattaccgttgtgttcccgaaacctccggcgtcagtgctggaaaagtggcaaatcgcaaccgagggcgacgatgcgcatatttgcttaatgccaagtaccacccgtcagcatgtcgatgaattgatcgctgacattgcggccgccaataaagcagctgcggcaccgagcgatacgcagaagcccgccgccaagaaacgcccgacaccggctggtgcaccgcaacgtactacgtag

SEQ ID NO: 418 - protein, 406 aa, Artificial Sequence
  Variant of Leucine Decarboxylase from Planctomycetaceae bacterium
MGNLKFPDGALSPTDRRRLEDVYQYVREQCDTFIGYPCNMHFDYTPLFPFLAYPVNNVGDPFAESSYRIHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKPYVERIARTIEYIGTLDTTISGSRNGITPLFLWYAVKQAGRDGFKRRVAACLDNARYTVEQFKRIGVEAMRNPCAITVVFPKPPASVLEKWQIATEGDDAHICLMPSTTRQHVDELIADIAAANKAAAAPSDTQKPAAKKRPTPAGAPQRTT

SEQ ID NO: 419 - DNA, 1221 bp, Artificial Sequence
  Variant of Leucine Decarboxylase from Planctomycetaceae bacterium
atggggatgctgaaatttccagatggcgcgttgagcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctagctccagttatcgcgtccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaatgacgaagctgcggcaccgagcgatacgcagaagtgagccgccaagaaacgcccgacaccggctggtgcaccgcaacgtactacgtag

SEQ ID NO: 420 - protein, 389 aa, Artificial Sequence
  Variant of Leucine Decarboxylase from Planctomycetaceae bacterium
MGMLKFPDGALSPTDRRRLEDVYQYVREQCDTFIGYPCNMHFDYTPLFPFLAYPVNNVGDPFASSSYRVHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKPYVERIARSIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTRQHVDELIADIAAANDEAAAPSDTQK

SEQ ID NO: 421 - DNA, 1218 bp, Artificial Sequence
  Variant of Leucine Decarboxylase from Planctomycetaceae bacterium
atggggaacctgaaatttccagatggcgcgttgagcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctagctccagttatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcgacatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagaagattgctcgcacgattgaatatatcggtaccctggacactacgatttcgggcagccgtaatggtattacaccgctgtttctttggtacgcggtgaaacaagctggacgcgatggcttcaaacgtcgtgttgcgcgttgtctggataacgcccgctatacggtcgagcagtttaaacgcatcggtgtagaagcgatgcgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagcggctgcagcaccgagcgatacgcagaaacccgccgccaagaaacgcccgacaccggctggtgcaccgcaacgtactacg

SEQ ID NO: 422 - protein, 406 aa, Artificial Sequence
  Variant of Leucine Decarboxylase from Planctomycetaceae bacterium
MGNLKFPDGALSPTDRRRLEDVYQYVREQCDTFIGYPCNMHFDYTPLFPFLAYPVNNVGDPFASSSYRIHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRDIQDMFKKLAIHESHIHCDAALAGMTLPFMDDAPAFDFATGIDSLSISGHKFIGSPMPCGIVLTRKPYVEKIARTIEYIGTLDTTISGSRNGITPLFLWYAVKQAGRDGFKRRVARCLDNARYTVEQFKRIGVEAMRNPCAITVVFPKPPQSVLEKWQIATEGDDAHICLMPSTTRQHVDELIADIAAANKAAAAPSDTQKPAAKKRPTPAGAPQRTT

SEQ ID NO: 423 - DNA, 1221 bp, Artificial Sequence
  Variant of Leucine Decarboxylase from Planctomycetaceae bacterium
atggggatgctgaaatttccagatggcgcgttgagcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctagctccagttatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagcggctgcggcaccgagcgatacgcagggtcccgccgccaagaaacgcccgacaccggctggtgcaccgcaacgtactacgtag

SEQ ID NO: 424 - protein, 406 aa, Artificial Sequence
  Variant of Leucine Decarboxylase from Planctomycetaceae bacterium
MGMLKFPDGALSPTDRRRLEDVYQYVREQCDTFIGYPCNMHFDYTPLFPFLAYPVNNVGDPFASSSYRIHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKPYVERIARSIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTRQHVDELIADIAAANKAAAAPSDTQGPAAKKRPTPAGAPQRTT

SEQ ID NO: 425 - DNA, 1218 bp, Artificial Sequence
  Variant of Leucine Decarboxylase from Planctomycetaceae bacterium
atggggaacctgaaatttccagatggcgcgttgagcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctagctccagttatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaagctggcgattcacgaatctcatatccattgtgacgcagcattagcggggatgaccctgccctttatggatgatgccccaatgtttgactttgccactggcattgattcgcttagcatctccggtcacaaattcattgggtctccgatgccttgcggcatcgttttgacacgcaaaccttatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagcagctgcggcaccgagcgatacggccaagcccgccgccaagaaacgcccgacaccggctggtgcaccgcaacgtactacg

SEQ ID NO: 426 - protein, 406 aa, Artificial Sequence
  Variant of Leucine Decarboxylase from Planctomycetaceae bacterium
MGNLKFPDGALSPTDRRRLEDVYQYVREQCDTFIGYPCNMHFDYTPLFPFLAYPVNNVGDPFASSSYRIHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPMFDFATGIDSLSISGHKFIGSPMPCGIVLTRKPYVERIARSIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTRQHVDELIADIAAANKAAAAPSDTAKPAAKKRPTPAGAPQRTT

SEQ ID NO: 427 - DNA, 1221 bp, Artificial Sequence
  Variant of Leucine Decarboxylase from Planctomycetaceae bacterium
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctgagtccagttatcgcgtccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagcgtattgctcgcactattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgcgccattaccgttgtgttcccgaaacctccggcgtcagtgctggaaaagtggcaaatcgcaaccgagggcgacgatgcgcatatttgcttaatgccaagtaccacccgtcagcatgtcgatgaattgatcgctgacattgcggccgccaataaagcggctgcagcaccgagcgatacgcagggttgagccgccaagaaacgcccgacaccggctggtgcaccgcaacgtactacgtag

SEQ ID NO: 428 - protein, 389 aa, Artificial Sequence
  Variant of Leucine Decarboxylase from Planctomycetaceae bacterium
MGNLKFPDGALSPTDRRRLEDVYQYVREQCDTFIGYPCNMHFDYTPLFPFLAYPVNNVGDPFAESSYRVHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKPYVERIARTIEYIGTLDTTISGSRNGITPLFLWYAVKQAGRDGFKRRVAACLDNARYTVEQFKRIGVEAMRNPCAITVVFPKPPASVLEKWQIATEGDDAHICLMPSTTRQHVDELIADIAAANKAAAAPSDTQG

SEQ ID NO: 429 - DNA, 1221 bp, Artificial Sequence
  Variant of Leucine Decarboxylase from Planctomycetaceae bacterium
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctgagtccagttatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagcgtattgctcgcactattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagcggctgcagcaccgagcgatacggccaagcccgccgccaagaaacgcccgacaccggctggtgcaccgcaacgtactacgtag

SEQ ID NO: 430 - protein, 406 aa, Artificial Sequence
  Variant of Leucine Decarboxylase from Planctomycetaceae bacterium
MGNLKFPDGALSPTDRRRLEDVYQYVREQCDTFIGYPCNMHFDYTPLFPFLAYPVNNVGDPFAESSYRIHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKPYVERIARTIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTRQHVDELIADIAAANKAAAAPSDTAKPAAKKRPTPAGAPQRTT

SEQ ID NO: 431 - DNA, 1221 bp, Artificial Sequence
  Variant of Leucine Decarboxylase from Planctomycetaceae bacterium
atggagaacctgaaatttccagatggcgcgttgagcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctagctccagttatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgagccgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagaagcttcggcaccgagcgatacggccggtcccgccgccaagaaacgcccgacaccggctggtgcaccgcaacgtactacgtag

SEQ ID NO: 432 - protein, 406 aa, Artificial Sequence
  Variant of Leucine Decarboxylase from Planctomycetaceae bacterium
MENLKFPDGALSPTDRRRLEDVYQYVREQCDTFIGYPCNMHFDYTPLFPFLAYPVNNVGDPFASSSYRIHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKPYVERIARSIEYIGTLDTTISGSRNGITPLFLWYAVKQAGRDGFKRRVAACLDNARYTVEQFKRIGVEASRNPCAITVVFPKPPQSVLEKWQIATEGDDAHICLMPSTTRQHVDELIADIAAANKEASAPSDTAGPAAKKRPTPAGAPQRTT

SEQ ID NO: 433 - DNA, 1221 bp, Artificial Sequence
  Variant of Leucine Decarboxylase from Planctomycetaceae bacterium
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctagctccagttatcgcgtccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgagccgtaatccatgcgccattaccgttgtgttcccgaaacctccggcgtcagtgctggaaaagtggcaaatcgcaaccgagggcgacgatgcgcatatttgcttaatgccaagtaccacccgtcagcatgtcgatgaattgatcgctgacattgcggccgccaataaagcggctgcagcaccgagcgatacgcagggttgagccgccaagaaacgcccgacaccggctggtgcaccgcaacgtactacgtag

SEQ ID NO: 434 - protein, 389 aa, Artificial Sequence
  Variant of Leucine Decarboxylase from Planctomycetaceae bacterium
MGNLKFPDGALSPTDRRRLEDVYQYVREQCDTFIGYPCNMHFDYTPLFPFLAYPVNNVGDPFASSSYRVHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKPYVERIARSIEYIGTLDTTISGSRNGITPLFLWYAVKQAGRDGFKRRVAACLDNARYTVEQFKRIGVEASRNPCAITVVFPKPPASVLEKWQIATEGDDAHICLMPSTTRQHVDELIADIAAANKAAAAPSDTQG

SEQ ID NO: 435 - DNA, 1221 bp, Artificial Sequence
  Variant of Leucine Decarboxylase from Planctomycetaceae bacterium
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctgagtccagttatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccaatgtttgactttgccactggcattgattcgcttagcatctccggtcacaaattcattgggtctccgatgccttgcggcatcgttttgacacgcaaaccttatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgagccgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaatgacgaagcttcggcaccgagcgatacggccaagtgagccgccaagaaacgcccgacaccggctggtgcaccgcaacgtactacgtag

SEQ ID NO: 436 - protein, 389 aa, Artificial Sequence
  Variant of Leucine Decarboxylase from Planctomycetaceae bacterium
MGNLKFPDGALSPTDRRRLEDVYQYVREQCDTFIGYPCNMHFDYTPLFPFLAYPVNNVGDPFAESSYRIHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPMFDFATGIDSLSISGHKFIGSPMPCGIVLTRKPYVERIARSIEYIGTLDTTISGSRNGITPLFLWYAVKQAGRDGFKRRVAACLDNARYTVEQFKRIGVEASRNPCAITVVFPKPPQSVLEKWQIATEGDDAHICLMPSTTRQHVDELIADIAAANDEASAPSDTAK

SEQ ID NO: 437 - DNA, 1221 bp, Artificial Sequence
  Variant of Leucine Decarboxylase from Planctomycetaceae bacterium
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctagctccagttatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgcgccattaccgttgtgttcccgaaacctccggcgtcagtgctggaaaagtggcaaatcgcaaccgagggcgacgatgcgcatatttgcttaatgccaagtaccacccgtcagcatgtcgatgaattgatcgctgacattgcggccgccaataaagcagcttcggcaccgagcgatacggccggtcccgccgccaagaaacgcccgacaccggctggtgcaccgcaacgtactacgtag

SEQ ID NO: 438 - protein, 406 aa, Artificial Sequence
  Variant of Leucine Decarboxylase from Planctomycetaceae bacterium
MGNLKFPDGALSPTDRRRLEDVYQYVREQCDTFIGYPCNMHFDYTPLFPFLAYPVNNVGDPFASSSYRIHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKPYVERIARSIEYIGTLDTTISGSRNGITPLFLWYAVKQAGRDGFKRRVAACLDNARYTVEQFKRIGVEAMRNPCAITVVFPKPPASVLEKWQIATEGDDAHICLMPSTTRQHVDELIADIAAANKAASAPSDTAGPAAKKRPTPAGAPQRTT

SEQ ID NO: 439 - DNA, 1221 bp, Artificial Sequence
  Variant of Leucine Decarboxylase from Planctomycetaceae bacterium
atggggatgctgaaatttccagatggcgcgttgagcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctagctccagttatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagcggctgcagcaccgagcgatacgcagaagtgagccgccaagaaacgcccgacaccggctggtgcaccgcaacgtactacgtag

SEQ ID NO: 440 - protein, 389 aa, Artificial Sequence
  Variant of Leucine Decarboxylase from Planctomycetaceae bacterium
MGMLKFPDGALSPTDRRRLEDVYQYVREQCDTFIGYPCNMHFDYTPLFPFLAYPVNNVGDPFASSSYRIHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKPYVERIARSIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTRQHVDELIADIAAANKAAAAPSDTQK

SEQ ID NO: 441 - DNA, 1221 bp, Artificial Sequence
  Variant of Leucine Decarboxylase from Planctomycetaceae bacterium
atggggaacctgaaatttccagatggcgcgttgagcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctagctccagttatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagcggctgcggcaccgagcgatacgcagaagtgagccgccaagaaacgcccgacaccggctggtgcaccgcaacgtactacgtag

SEQ ID NO: 442 - protein, 389 aa, Artificial Sequence
  Variant of Leucine Decarboxylase from Planctomycetaceae bacterium
MGNLKFPDGALSPTDRRRLEDVYQYVREQCDTFIGYPCNMHFDYTPLFPFLAYPVNNVGDPFASSSYRIHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKPYVERIARSIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTRQHVDELIADIAAANKAAAAPSDTQK

SEQ ID NO: 443 - DNA, 1221 bp, Artificial Sequence
  Variant of Leucine Decarboxylase from Planctomycetaceae bacterium
atggggatgctgaaatttccagatggcgcgttgagcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctgagtccagttatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgagccgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagcggctgcagcaccgagcgatacgcagaagcccgccgccaagaaacgcccgacaccggctggtgcaccgcaacgtactacgtag

SEQ ID NO: 444 - protein, 406 aa, Artificial Sequence
  Variant of Leucine Decarboxylase from Planctomycetaceae bacterium
MGMLKFPDGALSPTDRRRLEDVYQYVREQCDTFIGYPCNMHFDYTPLFPFLAYPVNNVGDPFAESSYRIHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKPYVERIARSIEYIGTLDTTISGSRNGITPLFLWYAVKQAGRDGFKRRVAACLDNARYTVEQFKRIGVEASRNPCAITVVFPKPPQSVLEKWQIATEGDDAHICLMPSTTRQHVDELIADIAAANKAAAAPSDTQKPAAKKRPTPAGAPQRTT

SEQ ID NO: 445 - DNA, 1167 bp, Artificial Sequence
  Variant of Leucine Decarboxylase from Planctomycetaceae bacterium
atgggtaatctgaaatttccagatggcgcgttgagcccgaccgaccaacgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgcaagctccagttatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctacttttcggaagattcgcattatagcgtgtataagaatctgcgtctgctgaacatgcgtcacatcatgatcaaatcacagccgaatggtgagattgattacggcgatctctacgaaactatgcgcgctcatcgtgataagccgccgatcatcttcgctaacattggtacgacgatgaccgaaggcattgacaacgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgtgccattaccgttgtgttcccgaaacctccgcagtcagtgctggaaaagtggcaaatcgcaaccgagggcgacgatgcgcatatttgcttaatgccaagtaccacccgtcagatggtcgatgaattgatcgctgacattgcggccgccaataaagaagctgcggcaccgagcgatacggccaag

SEQ ID NO: 446 - protein, 389 aa, Artificial Sequence
  Variant of Leucine Decarboxylase from Planctomycetaceae bacterium
MGNLKFPDGALSPTDQRRLEDVYQYVREQCDTFIGYPCNMHFDYTPLFPFLAYPVNNVGDPFASSSYRIHTREIEREVLAWFAELMHIAPEEYWGYVTNGGSEGNLYGLFLARERFPTGVAYFSEDSHYSVYKNLRLLNMRHIMIKSQPNGEIDYGDLYETMRAHRDKPPIIFANIGTTMTEGIDNVRTIQDMFKKLAIHESHIHCDAALAGMTLPFMDDAPAFDFATGIDSLSISGHKFIGSPMPCGIVLTRKPYVEKIATSIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTRQMVDELIADIAAANKEAAAPSDTAK

SEQ ID NO: 447 - DNA, 1221 bp, Artificial Sequence
  Variant of Leucine Decarboxylase from Planctomycetaceae bacterium
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctagctccagttatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccaatgtttgactttgccactggcattgattcgcttagcatctccggtcacaaattcattgggtctccgatgccttgcggcatcgttttgacacgcaaaccttatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagcagctgcggcaccgagcgatacggccggttgagccgccaagaaacgcccgacaccggctggtgcaccgcaacgtactacgtag

SEQ ID NO: 448 - protein, 389 aa, Artificial Sequence
  Variant of Leucine Decarboxylase from Planctomycetaceae bacterium
MGNLKFPDGALSPTDRRRLEDVYQYVREQCDTFIGYPCNMHFDYTPLFPFLAYPVNNVGDPFASSSYRIHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPMFDFATGIDSLSISGHKFIGSPMPCGIVLTRKPYVERIARSIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTRQHVDELIADIAAANKAAAAPSDTAG

SEQ ID NO: 449 - DNA, 1221 bp, Artificial Sequence
  Variant of Leucine Decarboxylase from Planctomycetaceae bacterium
atgggtaacctgaaatttccagatggcgcgttgagcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctagctccagttatcgcgtccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagcgtattgctcgcactattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagcggctgcagcaccgagcgatacgcagaagcccgccgccaagaaacgcccgacaccggctggtgcaccgcaacgtactacgtag

SEQ ID NO: 450 - protein, 406 aa, Artificial Sequence
  Variant of Leucine Decarboxylase from Planctomycetaceae bacterium
MGNLKFPDGALSPTDRRRLEDVYQYVREQCDTFIGYPCNMHFDYTPLFPFLAYPVNNVGDPFASSSYRVHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKPYVERIARTIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTRQHVDELIADIAAANKAAAAPSDTQKPAAKKRPTPAGAPQRTT

SEQ ID NO: 451 - DNA, 1221 bp, Artificial Sequence
  Variant of Leucine Decarboxylase from Planctomycetaceae bacterium
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctgcgtccagttatcgcgtgcatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaacattatgtggagcgtattgctcgcactattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagcagctgcggcaccgagcgatacgcagaagcccgccgccaagaaacgcccgacaccggctggtgcaccgcaacgtactacgtag

SEQ ID NO: 452 - protein, 406 aa, Artificial Sequence
  Variant of Leucine Decarboxylase from Planctomycetaceae bacterium
MGNLKFPDGALSPTDRRRLEDVYQYVREQCDTFIGYPCNMHFDYTPLFPFLAYPVNNVGDPFAASSYRVHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKHYVERIARTIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTRQHVDELIADIAAANKAAAAPSDTQKPAAKKRPTPAGAPQRTT

SEQ ID NO: 453 - DNA, 1221 bp, Artificial Sequence
  Variant of Leucine Decarboxylase from Planctomycetaceae bacterium
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctgagtccagttatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagcagcttcggcaccgagcgatacgcagaagtgagccgccaagaaacgcccgacaccggctggtgcaccgcaacgtactacgtag

SEQ ID NO: 454 - protein, 389 aa, Artificial Sequence
  Variant of Leucine Decarboxylase from Planctomycetaceae bacterium
MGNLKFPDGALSPTDRRRLEDVYQYVREQCDTFIGYPCNMHFDYTPLFPFLAYPVNNVGDPFAESSYRIHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKPYVERIARSIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTRQHVDELIADIAAANKAASAPSDTQK

SEQ ID NO: 455 - DNA, 1221 bp, Artificial Sequence
  Variant of Leucine Decarboxylase from Planctomycetaceae bacterium
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctgagtccagttatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgagccgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagaagctgcggcaccgagcgatacgcagaagcccgccgccaagaaacgcccgacaccggctggtgcaccgcaacgtactacgtag

SEQ ID NO: 456 - protein, 406 aa, Artificial Sequence
  Variant of Leucine Decarboxylase from Planctomycetaceae bacterium
MGNLKFPDGALSPTDRRRLEDVYQYVREQCDTFIGYPCNMHFDYTPLFPFLAYPVNNVGDPFAESSYRIHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKPYVERIARSIEYIGTLDTTISGSRNGITPLFLWYAVKQAGRDGFKRRVAACLDNARYTVEQFKRIGVEASRNPCAITVVFPKPPQSVLEKWQIATEGDDAHICLMPSTTRQHVDELIADIAAANKEAAAPSDTQKPAAKKRPTPAGAPQRTT

SEQ ID NO: 457 - DNA, 1221 bp, Artificial Sequence
  Variant of Leucine Decarboxylase from Planctomycetaceae bacterium
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctgagtccagttatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagcgtattgctcgcactattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgagccgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagcggctgcagcaccgagcgatacgcagaaacccgccgccaagaaacgcccgacaccggctggtgcaccgcaacgtactacgtag

SEQ ID NO: 458 - protein, 406 aa, Artificial Sequence
  Variant of Leucine Decarboxylase from Planctomycetaceae bacterium
MGNLKFPDGALSPTDRRRLEDVYQYVREQCDTFIGYPCNMHFDYTPLFPFLAYPVNNVGDPFAESSYRIHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKPYVERIARTIEYIGTLDTTISGSRNGITPLFLWYAVKQAGRDGFKRRVAACLDNARYTVEQFKRIGVEASRNPCAITVVFPKPPQSVLEKWQIATEGDDAHICLMPSTTRQHVDELIADIAAANKAAAAPSDTQKPAAKKRPTPAGAPQRTT

SEQ ID NO: 459 - DNA, 1221 bp, Artificial Sequence
  Variant of Leucine Decarboxylase from Planctomycetaceae bacterium
atggggaacctgaaatttccagatggcgcgttgagcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctagctccagttatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagcggctgcagcaccgagcgatacgcagaaacccgccgccaagaaacgcccgacaccggctggtgcaccgcaacgtactacgtag

SEQ ID NO: 460 - protein, 406 aa, Artificial Sequence
  Variant of Leucine Decarboxylase from Planctomycetaceae bacterium
MGNLKFPDGALSPTDRRRLEDVYQYVREQCDTFIGYPCNMHFDYTPLFPFLAYPVNNVGDPFASSSYRIHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKPYVERIARSIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTRQHVDELIADIAAANKAAAAPSDTQKPAAKKRPTPAGAPQRTT

SEQ ID NO: 461 - DNA, 1221 bp, Artificial Sequence
  Variant of Leucine Decarboxylase from Planctomycetaceae bacterium
atggggaacctgaaatttccagatggcgcgttgagcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctagctccagttatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgcgccattaccgttgtgttcccgaaacctccggcgtcagtgctggaaaagtggcaaatcgcaaccgagggcgacgatgcgcatatttgcttaatgccaagtaccacccgtcagcatgtcgatgaattgatcgctgacattgcggccgccaataaagcggctgcggcaccgagcgatacgcagaagcccgccgccaagaaacgcccgacaccggctggtgcaccgcaacgtactacgtag

SEQ ID NO: 462 - protein, 406 aa, Artificial Sequence
  Variant of Leucine Decarboxylase from Planctomycetaceae bacterium
MGNLKFPDGALSPTDRRRLEDVYQYVREQCDTFIGYPCNMHFDYTPLFPFLAYPVNNVGDPFASSSYRIHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKPYVERIARSIEYIGTLDTTISGSRNGITPLFLWYAVKQAGRDGFKRRVAACLDNARYTVEQFKRIGVEAMRNPCAITVVFPKPPASVLEKWQIATEGDDAHICLMPSTTRQHVDELIADIAAANKAAAAPSDTQKPAAKKRPTPAGAPQRTT

SEQ ID NO: 463 - DNA, 1221 bp, Artificial Sequence
  Variant of Leucine Decarboxylase from Planctomycetaceae bacterium
atggggaacctgaaatttccagatggcgcgttgagcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctagctccagttatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgagccgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagcggctgcagcaccgagcgatacgcagaaacccgccgccaagaaacgcccgacaccggctggtgcaccgcaacgtactacgtag

SEQ ID NO: 464 - protein, 406 aa, Artificial Sequence
  Variant of Leucine Decarboxylase from Planctomycetaceae bacterium
MGNLKFPDGALSPTDRRRLEDVYQYVREQCDTFIGYPCNMHFDYTPLFPFLAYPVNNVGDPFASSSYRIHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKPYVERIARSIEYIGTLDTTISGSRNGITPLFLWYAVKQAGRDGFKRRVAACLDNARYTVEQFKRIGVEASRNPCAITVVFPKPPQSVLEKWQIATEGDDAHICLMPSTTRQHVDELIADIAAANKAAAAPSDTQKPAAKKRPTPAGAPQRTT

SEQ ID NO: 465 - DNA, 1221 bp, Artificial Sequence
  Variant of Leucine Decarboxylase from Planctomycetaceae bacterium
atggggatgctgaaatttccagatggcgcgttgagcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctgagtccagttatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagcgtattgctcgcactattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagaagctgcggcaccgagcgatacgcagaagcccgccgccaagaaacgcccgacaccggctggtgcaccgcaacgtactacgtag

SEQ ID NO: 466 - protein, 406 aa, Artificial Sequence
  Variant of Leucine Decarboxylase from Planctomycetaceae bacterium
MGMLKFPDGALSPTDRRRLEDVYQYVREQCDTFIGYPCNMHFDYTPLFPFLAYPVNNVGDPFAESSYRIHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKPYVERIARTIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTRQHVDELIADIAAANKEAAAPSDTQKPAAKKRPTPAGAPQRTT

SEQ ID NO: 467 - DNA, 1221 bp, Artificial Sequence
  Variant of Leucine Decarboxylase from Planctomycetaceae bacterium
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctgaatccagttatcgcgtgcatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagaagattgctcgcacgattgaatatatcggtaccctggacactacgatttcgggcagccgtaatggtattacaccgctgtttctttggtacgcggtgaaacaagctggacgcgatggcttcaaacgtcgtgttgcgcgttgtctggataacgcccgctatacggtcgagcagtttaaacgcatcggtgtagaagcgatgcgtaatccatgcgccattaccgttgtgttcccgaaacctccggctactgtgctggaaaagtggcaaatcgcaaccgagggcgacgatgcgcatatttgcttaatgccaagtaccacccgtcagcatgtcgatgaattgatcgctgacattgcggccgccaataatgcggctgccgcaccgagcgatacgcagaaacccgccgccaagaaacgcccgacaccggctggtgcaccgcaacgtactacgtag

SEQ ID NO: 468 - protein, 406 aa, Artificial Sequence
  Variant of Leucine Decarboxylase from Planctomycetaceae bacterium
MGNLKFPDGALSPTDRRRLEDVYQYVREQCDTFIGYPCNMHFDYTPLFPFLAYPVNNVGDPFAESSYRVHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKPYVEKIARTIEYIGTLDTTISGSRNGITPLFLWYAVKQAGRDGFKRRVARCLDNARYTVEQFKRIGVEAMRNPCAITVVFPKPPATVLEKWQIATEGDDAHICLMPSTTRQHVDELIADIAAANNAAAAPSDTQKPAAKKRPTPAGAPQRTT

SEQ ID NO: 469 - DNA, 1221 bp, Artificial Sequence
  Variant of Leucine Decarboxylase from Planctomycetaceae bacterium
atggggaatctgaaatttccagatggcgcgttgagcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctgaatccagttatcgcgtgcatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagaagattgctcgcacgattgaatatatcggtaccctggacactacgatttcgggcagccgtaatggtattacaccgctgtttctttggtacgcggtgaaacaagctggacgcgatggcttcaaacgtcgtgttgcgcgttgtctggataacgcccgctatacggtcgagcagtttaaacgcatcggtgtagaagcgatgcgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagcggctgcagcaccgagcgatacgcagaaacccgccgccaagaaacgcccgacaccggctggtgcaccgcaacgtactacgtag

SEQ ID NO: 470 - protein, 406 aa, Artificial Sequence
  Variant of Leucine Decarboxylase from Planctomycetaceae bacterium
MGNLKFPDGALSPTDRRRLEDVYQYVREQCDTFIGYPCNMHFDYTPLFPFLAYPVNNVGDPFAESSYRVHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKPYVEKIARTIEYIGTLDTTISGSRNGITPLFLWYAVKQAGRDGFKRRVARCLDNARYTVEQFKRIGVEAMRNPCAITVVFPKPPQSVLEKWQIATEGDDAHICLMPSTTRQHVDELIADIAAANKAAAAPSDTQKPAAKKRPTPAGAPQRTT

SEQ ID NO: 471 - DNA, 1221 bp, Artificial Sequence
  Variant of Leucine Decarboxylase from Planctomycetaceae bacterium
atgggtaatctgaaatttccagatggcgcgttgggcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctgaatccagttatcgcgtgcatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagaagattgctcgcacgattgaatatatcggtaccctggacactacgatttcgggcagccgtaatggtattacaccgctgtttctttggtacgcggtgaaacaagctggacgcgatggcttcaaacgtcgtgttgcgcgttgtctggataacgcccgctatacggtcgagcagtttaaacgcatcggtgtagaagcgatgcgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagcggctgcagcaccgagcgatacgcagaaacccgccgccaagaaacgcccgacaccggctggtgcaccgcaacgtactacgtag

SEQ ID NO: 472 - protein, 406 aa, Artificial Sequence
  Variant of Leucine Decarboxylase from Planctomycetaceae bacterium
MGNLKFPDGALGPTDRRRLEDVYQYVREQCDTFIGYPCNMHFDYTPLFPFLAYPVNNVGDPFAESSYRVHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKPYVEKIARTIEYIGTLDTTISGSRNGITPLFLWYAVKQAGRDGFKRRVARCLDNARYTVEQFKRIGVEAMRNPCAITVVFPKPPQSVLEKWQIATEGDDAHICLMPSTTRQHVDELIADIAAANKAAAAPSDTQKPAAKKRPTPAGAPQRTT

SEQ ID NO: 473 - DNA, 1221 bp, Artificial Sequence
  Variant of Leucine Decarboxylase from Planctomycetaceae bacterium
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctagctccagttatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagcgcattgctcgctcgattgaatatatcggtaccctggacactacgatttcgggcagccgtaatggtattacaccgctgtttctttggtacgcggtgaaacaagctggacgcgatggcttcaaacgtcgtgttgcggcttgtctggataacgcccgctatacggtcgagcagtttaaacgcatcggtgtagaagcgatgcgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaatgatgaggctgccgcaccgagcgatacgcagaaacccgccgccaagaaacgcccgacaccggctggtgcaccgcaacgtactacgtag

SEQ ID NO: 474 - protein, 406 aa, Artificial Sequence
  Variant of Leucine Decarboxylase from Planctomycetaceae bacterium
MGNLKFPDGALSPTDRRRLEDVYQYVREQCDTFIGYPCNMHFDYTPLFPFLAYPVNNVGDPFASSSYRIHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKPYVERIARSIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTRQHVDELIADIAAANDEAAAPSDTQKPAAKKRPTPAGAPQRTT

SEQ ID NO: 475 - DNA, 1221 bp, Artificial Sequence
  Variant of Leucine Decarboxylase from Planctomycetaceae bacterium
atgggtaatctgaaatttccagatggcgcgttgggcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctgaatccagttatcgcgtgcatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatgtgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagaagattgctcgcacgattgaatatatcggtaccctggacactacgatttcgggcagccgtaatggtattacaccgctgtttctttggtacgcggtgaaacaagctggacgcgatggcttcaaacgtcgtgttgcggcttgtctggataacgcccgctatacggtcgagcagtttaaacgcatcggtgtagaagcgatgcgtaatccatgcgccattaccgttgtgttcccgaaacctccgcaaagtgtgctggaaaagtggcaaatcgcaaccgagggcgacgatgcgcatatttgcttaatgccaagtaccacccgtcagcatgtcgatgaattgatcgctgacattgcggccgccaataaagcggctgccgcaccgagcgatacgcagaaacccgccgccaagaaacgcccgacaccggctggtgcaccgcaacgtactacgtag

SEQ ID NO: 476 - protein, 406 aa, Artificial Sequence
  Variant of Leucine Decarboxylase from Planctomycetaceae bacterium
MGNLKFPDGALGPTDRRRLEDVYQYVREQCDTFIGYPCNMHFDYTPLFPFLAYPVNNVGDPFAESSYRVHTREIEREVLAWFAELMHIAPEEYWGYVTNGGSEGNLYGLFLARERFPTGVAYYSEDSHYSVYKNVRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKPYVEKIARTIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTRQHVDELIADIAAANKAAAAPSDTQKPAAKKRPTPAGAPQRTT

SEQ ID NO: 477 - DNA, 1218 bp, Artificial Sequence
  Variant of Leucine Decarboxylase from Planctomycetaceae bacterium
atggggaacctgaaatttccagatggcgcgttgagcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctagctccagttatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcgcgttgtctggataacgcccgctatacggtcgagcagtttaaacgcatcggtgtagaagcgatgcgtaatccatgcgccattaccgttgtgttcccgaaacctccgcaaagtgtgctggaaaagtggcaaatcgcaaccgagggcgacgatgcgcatatttgcttaatgccaagtaccacccgtcagcatgtcgatgaattgatcgctgacattgcggccgccaatgaggcggctggcgcaccgagcgatacgcagaaacccgccgccaagaaacgcccgacaccggctggtgcaccgcaacgtactacg

SEQ ID NO: 478 - protein, 406 aa, Artificial Sequence
  Variant of Leucine Decarboxylase from Planctomycetaceae bacterium
MGNLKFPDGALSPTDRRRLEDVYQYVREQCDTFIGYPCNMHFDYTPLFPFLAYPVNNVGDPFASSSYRIHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKPYVERIARSIEYIGTLDTTISGSRNGITPLFLWYAVKQAGRDGFKRRVARCLDNARYTVEQFKRIGVEAMRNPCAITVVFPKPPQSVLEKWQIATEGDDAHICLMPSTTRQHVDELIADIAAANEAAGAPSDTQKPAAKKRPTPAGAPQRTT

SEQ ID NO: 479 - DNA, 1221 bp, Artificial Sequence
  Variant of Leucine Decarboxylase from Planctomycetaceae bacterium
atggggaatctgaaatttccagatggcgcgttgagcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctgaatccagttatcgcgtgcatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagcgcattgctcgctcgattgaatatatcggtaccctggacactacgatttcgggcagccgtaatggtattacaccgctgtttctttggtacgcggtgaaacaagctggacgcgatggcttcaaacgtcgtgttgcgcgttgtctggataacgcccgctatacggtcgagcagtttaaacgcatcggtgtagaagcgatgcgtaatccatgcgccattaccgttgtgttcccgaaacctccgcaaactgtgctggaaaagtggcaaatcgcaaccgagggcgacgatgcgcatatttgcttaatgccaagtaccacccgtcagcatgtcgatgaattgatcgctgacattgcggccgccaatgatgaggctggcgcaccgagcgatacgcagaaacccgccgccaagaaacgcccgacaccggctggtgcaccgcaacgtactacgtag

SEQ ID NO: 480 - protein, 406 aa, Artificial Sequence
  Variant of Leucine Decarboxylase from Planctomycetaceae bacterium
MGNLKFPDGALSPTDRRRLEDVYQYVREQCDTFIGYPCNMHFDYTPLFPFLAYPVNNVGDPFAESSYRVHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKPYVERIARSIEYIGTLDTTISGSRNGITPLFLWYAVKQAGRDGFKRRVARCLDNARYTVEQFKRIGVEAMRNPCAITVVFPKPPQTVLEKWQIATEGDDAHICLMPSTTRQHVDELIADIAAANDEAGAPSDTQKPAAKKRPTPAGAPQRTT

SEQ ID NO: 481 - DNA, 1221 bp, Artificial Sequence
  Variant of Leucine Decarboxylase from Planctomycetaceae bacterium
atggggaatctgaaatttccagatggcgcgttgggcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctgaatccagttatcgcgtgcatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatgtgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagcgcattgctcgcacgattgaatatatcggtaccctggacactacgatttcgggcagccgtaatggtattacaccgctgtttctttggtacgcggtgaaacaagctggacgcgatggcttcaaacgtcgtgttgcggcttgtctggataacgcccgctatacggtcgagcagtttaaacgcatcggtgtagaagcgatgcgtaatccatgcgccattaccgttgtgttcccgaaacctccgcaaagtgtgctggaaaagtggcaaatcgcaaccgagggcgacgatgcgcatatttgcttaatgccaagtaccacccgtcagcatgtcgatgaattgatcgctgacattgcggccgccaataaggcggctggcgcaccgagcgatacgcagaaacccgccgccaagaaacgcccgacaccggctggtgcaccgcaacgtactacgtag

SEQ ID NO: 482 - protein, 406 aa, Artificial Sequence
  Variant of Leucine Decarboxylase from Planctomycetaceae bacterium
MGNLKFPDGALGPTDRRRLEDVYQYVREQCDTFIGYPCNMHFDYTPLFPFLAYPVNNVGDPFAESSYRVHTREIEREVLAWFAELMHIAPEEYWGYVTNGGSEGNLYGLFLARERFPTGVAYYSEDSHYSVYKNVRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKPYVERIARTIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTRQHVDELIADIAAANKAAGAPSDTQKPAAKKRPTPAGAPQRTT

SEQ ID NO: 483 - DNA, 1167 bp, Artificial Sequence
  Variant of Leucine Decarboxylase from Planctomycetaceae bacterium
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctagctccagttatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagaagctgcggcaccgagcgatacggccaag

SEQ ID NO: 484 - protein, 389 aa, Artificial Sequence
  Variant of Leucine Decarboxylase from Planctomycetaceae bacterium
MGNLKFPDGALSPTDRRRLEDVYQYVREQCDTFIGYPCNMHFDYTPLFPFLAYPVNNVGDPFASSSYRIHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKPYVERIARSIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTRQHVDELIADIAAANKEAAAPSDTAK

SEQ ID NO: 485 - DNA, 1167 bp, Artificial Sequence
  Variant of Leucine Decarboxylase from Planctomycetaceae bacterium
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctagctccagttatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctcgcagcattgaatatatcggtaccctggacactacgatttcgggcagccgtaatggtattacaccgctgtttctttggtacgcggtgaaacaagctggacgcgatggcttcaaacgtcgtgttgcgcgctgtctggataacgcccgctatacggtcgagcagtttaaacgcatcggtgtagaagcgatgcgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagaagctgcggcaccgagcgatacggccaag

SEQ ID NO: 486 - protein, 389 aa, Artificial Sequence
  Variant of Leucine Decarboxylase from Planctomycetaceae bacterium
MGNLKFPDGALSPTDRRRLEDVYQYVREQCDTFIGYPCNMHFDYTPLFPFLAYPVNNVGDPFASSSYRIHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKPYVEKIARSIEYIGTLDTTISGSRNGITPLFLWYAVKQAGRDGFKRRVARCLDNARYTVEQFKRIGVEAMRNPCAITVVFPKPPQSVLEKWQIATEGDDAHICLMPSTTRQHVDELIADIAAANKEAAAPSDTAK

SEQ ID NO: 487 - DNA, 1167 bp, Artificial Sequence
  Variant of Leucine Decarboxylase from Planctomycetaceae bacterium
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctagctccagttatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctcgcacgattgaatatatcggtaccctggacactacgatttcgggcagccgtaatggtattacaccgctgtttctttggtacgcggtgaaacaagctggacgcgatggcttcaaacgtcgtgttgcgcgctgtctggataacgcccgctatacggtcgagcagtttaaacgcatcggtgtagaagcgatgcgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagaagctgcggcaccgagcgatacggccaag

SEQ ID NO: 488 - protein, 389 aa, Artificial Sequence
  Variant of Leucine Decarboxylase from Planctomycetaceae bacterium
MGNLKFPDGALSPTDRRRLEDVYQYVREQCDTFIGYPCNMHFDYTPLFPFLAYPVNNVGDPFASSSYRIHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKPYVEKIARTIEYIGTLDTTISGSRNGITPLFLWYAVKQAGRDGFKRRVARCLDNARYTVEQFKRIGVEAMRNPCAITVVFPKPPQSVLEKWQIATEGDDAHICLMPSTTRQHVDELIADIAAANKEAAAPSDTAK

SEQ ID NO: 489 - DNA, 1167 bp, Artificial Sequence
  Variant of Leucine Decarboxylase from Planctomycetaceae bacterium
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctagctccagttatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctcgcacgattgaatatatcggtaccctggacactacgatttcgggcagccgtaatggtattacaccgctgtttctttggtacgcggtgaaacaagctggacgcgatggcttcaaacgtcgtgttgcgcgctgtctggataacgcccgctatacggtcgagcagtttaaacgcatcggtgtagaagcgtcgcgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagaagctgcggcaccgagcgatacggccaag

SEQ ID NO: 490 - protein, 389 aa, Artificial Sequence
  Variant of Leucine Decarboxylase from Planctomycetaceae bacterium
MGNLKFPDGALSPTDRRRLEDVYQYVREQCDTFIGYPCNMHFDYTPLFPFLAYPVNNVGDPFASSSYRIHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKPYVEKIARTIEYIGTLDTTISGSRNGITPLFLWYAVKQAGRDGFKRRVARCLDNARYTVEQFKRIGVEASRNPCAITVVFPKPPQSVLEKWQIATEGDDAHICLMPSTTRQHVDELIADIAAANKEAAAPSDTAK

SEQ ID NO: 491 - DNA, 1167 bp, Artificial Sequence
  Variant of Leucine Decarboxylase from Planctomycetaceae bacterium
atgggtatgctgaaatttccagatggcgcgttgagcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctagctccagttatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctcgcagcattgaatatatcggtaccctggacactacgatttcgggcagccgtaatggtattacaccgctgtttctttggtacgcggtgaaacaagctggacgcgatggcttcaaacgtcgtgttgcgcgctgtctggataacgcccgctatacggtcgagcagtttaaacgcatcggtgtagaagcgtcgcgtaatccatgcgccattaccgttgtgttcccgaaacctccggcctcagtgctggaaaagtggcaaatcgcaaccgagggcgacgatgcgcatatttgcttaatgccaagtaccacccgtcagcatgtcgatgaattgatcgctgacattgcggccgccaataaagaagctgcggcaccgagcgatacggccaag

SEQ ID NO: 492 - protein, 389 aa, Artificial Sequence
  Variant of Leucine Decarboxylase from Planctomycetaceae bacterium
MGMLKFPDGALSPTDRRRLEDVYQYVREQCDTFIGYPCNMHFDYTPLFPFLAYPVNNVGDPFASSSYRIHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKPYVEKIARSIEYIGTLDTTISGSRNGITPLFLWYAVKQAGRDGFKRRVARCLDNARYTVEQFKRIGVEASRNPCAITVVFPKPPASVLEKWQIATEGDDAHICLMPSTTRQHVDELIADIAAANKEAAAPSDTAK

SEQ ID NO: 493 - DNA, 1167 bp, Artificial Sequence
  Variant of Leucine Decarboxylase from Planctomycetaceae bacterium
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctagctccagttatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagcgtattgctcgcagcattgaatatatcggtaccctggacactacgatttcgggcagccgtaatggtattacaccgctgtttctttggtacgcggtgaaacaagctggacgcgatggcttcaaacgtcgtgttgcgcgctgtctggataacgcccgctatacggtcgagcagtttaaacgcatcggtgtagaagcgtcgcgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagaagctgcggcaccgagcgatacggccaag

SEQ ID NO: 494 - protein, 389 aa, Artificial Sequence
  Variant of Leucine Decarboxylase from Planctomycetaceae bacterium
MGNLKFPDGALSPTDRRRLEDVYQYVREQCDTFIGYPCNMHFDYTPLFPFLAYPVNNVGDPFASSSYRIHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKPYVERIARSIEYIGTLDTTISGSRNGITPLFLWYAVKQAGRDGFKRRVARCLDNARYTVEQFKRIGVEASRNPCAITVVFPKPPQSVLEKWQIATEGDDAHICLMPSTTRQHVDELIADIAAANKEAAAPSDTAK

SEQ ID NO: 495 - DNA, 1167 bp, Artificial Sequence
  Variant of Leucine Decarboxylase from Planctomycetaceae bacterium
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctagctccagttatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagcgcattgctcgcacgattgaatatatcggtaccctggacactacgatttcgggcagccgtaatggtattacaccgctgtttctttggtacgcggtgaaacaagctggacgcgatggcttcaaacgtcgtgttgcgcgctgtctggataacgcccgctatacggtcgagcagtttaaacgcatcggtgtagaagcgtcgcgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagaagctgcggcaccgagcgatacggccaag

SEQ ID NO: 496 - protein, 389 aa, Artificial Sequence
  Variant of Leucine Decarboxylase from Planctomycetaceae bacterium
MGNLKFPDGALSPTDRRRLEDVYQYVREQCDTFIGYPCNMHFDYTPLFPFLAYPVNNVGDPFASSSYRIHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKPYVERIARTIEYIGTLDTTISGSRNGITPLFLWYAVKQAGRDGFKRRVARCLDNARYTVEQFKRIGVEASRNPCAITVVFPKPPQSVLEKWQIATEGDDAHICLMPSTTRQHVDELIADIAAANKEAAAPSDTAK

SEQ ID NO: 497 - DNA, 1167 bp, Artificial Sequence
  Variant of Leucine Decarboxylase from Planctomycetaceae bacterium
atgggtatgctgaaatttccagatggcgcgttgagcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctagctccagttatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagcgcattgctcgcacgattgaatatatcggtaccctggacactacgatttcgggcagccgtaatggtattacaccgctgtttctttggtacgcggtgaaacaagctggacgcgatggcttcaaacgtcgtgttgcgcgctgtctggataacgcccgctatacggtcgagcagtttaaacgcatcggtgtagaagcgtcgcgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaggaagcttcggcaccgagcgatacggccaag

SEQ ID NO: 498 - protein, 389 aa, Artificial Sequence
  Variant of Leucine Decarboxylase from Planctomycetaceae bacterium
MGMLKFPDGALSPTDRRRLEDVYQYVREQCDTFIGYPCNMHFDYTPLFPFLAYPVNNVGDPFASSSYRIHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKPYVERIARTIEYIGTLDTTISGSRNGITPLFLWYAVKQAGRDGFKRRVARCLDNARYTVEQFKRIGVEASRNPCAITVVFPKPPQSVLEKWQIATEGDDAHICLMPSTTRQHVDELIADIAAANKEASAPSDTAK

SEQ ID NO: 499 - DNA, 1167 bp, Artificial Sequence
  Variant of Leucine Decarboxylase from Planctomycetaceae bacterium
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctagctccagttatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagcgcattgctcgcacgattgaatatatcggtaccctggacactacgatttcgggcagccgtaatggtattacaccgctgtttctttggtacgcggtgaaacaagctggacgcgatggcttcaaacgtcgtgttgcgcgctgtctggataacgcccgctatacggtcgagcagtttaaacgcatcggtgtagaagcgtcgcgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagaagcttcggcaccgagcgatacggccaag

SEQ ID NO: 500 - protein, 389 aa, Artificial Sequence
  Variant of Leucine Decarboxylase from Planctomycetaceae bacterium
MGNLKFPDGALSPTDRRRLEDVYQYVREQCDTFIGYPCNMHFDYTPLFPFLAYPVNNVGDPFASSSYRIHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKPYVERIARTIEYIGTLDTTISGSRNGITPLFLWYAVKQAGRDGFKRRVARCLDNARYTVEQFKRIGVEASRNPCAITVVFPKPPQSVLEKWQIATEGDDAHICLMPSTTRQHVDELIADIAAANKEASAPSDTAK

SEQ ID NO: 501 - DNA, 1167 bp, Artificial Sequence
  Variant of Leucine Decarboxylase from Planctomycetaceae bacterium
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctagctccagttatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagcgtattgctcgcagcattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgtcgcgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagaagctgcagcaccgagcgatacggccaag

SEQ ID NO: 502 - protein, 389 aa, Artificial Sequence
  Variant of Leucine Decarboxylase from Planctomycetaceae bacterium
MGNLKFPDGALSPTDRRRLEDVYQYVREQCDTFIGYPCNMHFDYTPLFPFLAYPVNNVGDPFASSSYRIHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKPYVERIARSIEYIGTLDTTISGSRNGITPLFLWYAVKQAGRDGFKRRVAACLDNARYTVEQFKRIGVEASRNPCAITVVFPKPPQSVLEKWQIATEGDDAHICLMPSTTRQHVDELIADIAAANKEAAAPSDTAK

SEQ ID NO: 503 - DNA, 1167 bp, Artificial Sequence
  Variant of Leucine Decarboxylase from Planctomycetaceae bacterium
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctagctccagttatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaggaagcttcggcaccgagcgatacggccaag

SEQ ID NO: 504 - protein, 389 aa, Artificial Sequence
  Variant of Leucine Decarboxylase from Planctomycetaceae bacterium
MGNLKFPDGALSPTDRRRLEDVYQYVREQCDTFIGYPCNMHFDYTPLFPFLAYPVNNVGDPFASSSYRIHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKPYVERIARSIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTRQHVDELIADIAAANKEASAPSDTAK

SEQ ID NO: 505 - DNA, 1167 bp, Artificial Sequence
  Variant of Leucine Decarboxylase from Planctomycetaceae bacterium
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctagctccagttatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctcgcagcattgaatatatcggtaccctggacactacgatttcgggcagccgtaatggtattacaccgctgtttctttggtacgcggtgaaacaagctggacgcgatggcttcaaacgtcgtgttgcgcgctgtctggataacgcccgctatacggtcgagcagtttaaacgcatcggtgtagaagcgtcgcgtaatccatgcgccattaccgttgtgttcccgaaacctccggcctcagtgctggaaaagtggcaaatcgcaaccgagggcgacgatgcgcatatttgcttaatgccaagtaccacccgtcagcatgtcgatgaattgatcgctgacattgcggccgccaataaagaagctgcagcaccgagcgatacggccaag

SEQ ID NO: 506 - protein, 389 aa, Artificial Sequence
  Variant of Leucine Decarboxylase from Planctomycetaceae bacterium
MGNLKFPDGALSPTDRRRLEDVYQYVREQCDTFIGYPCNMHFDYTPLFPFLAYPVNNVGDPFASSSYRIHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKPYVEKIARSIEYIGTLDTTISGSRNGITPLFLWYAVKQAGRDGFKRRVARCLDNARYTVEQFKRIGVEASRNPCAITVVFPKPPASVLEKWQIATEGDDAHICLMPSTTRQHVDELIADIAAANKEAAAPSDTAK

SEQ ID NO: 507 - DNA, 1167 bp, Artificial Sequence
  Variant of Leucine Decarboxylase from Planctomycetaceae bacterium
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctagctccagttatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagcgcattgctcgcacgattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgtcgcgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagaagctgcggcaccgagcgatacggccaag

SEQ ID NO: 508 - protein, 389 aa, Artificial Sequence
  Variant of Leucine Decarboxylase from Planctomycetaceae bacterium
MGNLKFPDGALSPTDRRRLEDVYQYVREQCDTFIGYPCNMHFDYTPLFPFLAYPVNNVGDPFASSSYRIHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKPYVERIARTIEYIGTLDTTISGSRNGITPLFLWYAVKQAGRDGFKRRVAACLDNARYTVEQFKRIGVEASRNPCAITVVFPKPPQSVLEKWQIATEGDDAHICLMPSTTRQHVDELIADIAAANKEAAAPSDTAK

SEQ ID NO: 509 - DNA, 1167 bp, Artificial Sequence
  Variant of Leucine Decarboxylase from Planctomycetaceae bacterium
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctagctccagttatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctcgcagcattgaatatatcggtaccctggacactacgatttcgggcagccgtaatggtattacaccgctgtttctttggtacgcggtgaaacaagctggacgcgatggcttcaaacgtcgtgttgcgcgctgtctggataacgcccgctatacggtcgagcagtttaaacgcatcggtgtagaagcgtcgcgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagaagctgcggcaccgagcgatacggccaag

SEQ ID NO: 510 - protein, 389 aa, Artificial Sequence
  Variant of Leucine Decarboxylase from Planctomycetaceae bacterium
MGNLKFPDGALSPTDRRRLEDVYQYVREQCDTFIGYPCNMHFDYTPLFPFLAYPVNNVGDPFASSSYRIHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKPYVEKIARSIEYIGTLDTTISGSRNGITPLFLWYAVKQAGRDGFKRRVARCLDNARYTVEQFKRIGVEASRNPCAITVVFPKPPQSVLEKWQIATEGDDAHICLMPSTTRQHVDELIADIAAANKEAAAPSDTAK

SEQ ID NO: 511 - DNA, 1167 bp, Artificial Sequence
  Variant of Leucine Decarboxylase from Planctomycetaceae bacterium
atgggtatgctgaaatttccagatggcgcgttgagcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctagctccagttatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctcgcagcattgaatatatcggtaccctggacactacgatttcgggcagccgtaatggtattacaccgctgtttctttggtacgcggtgaaacaagctggacgcgatggcttcaaacgtcgtgttgcgcgctgtctggataacgcccgctatacggtcgagcagtttaaacgcatcggtgtagaagcgatgcgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagaagctgcggcaccgagcgatacggccaag

SEQ ID NO: 512 - protein, 389 aa, Artificial Sequence
  Variant of Leucine Decarboxylase from Planctomycetaceae bacterium
MGMLKFPDGALSPTDRRRLEDVYQYVREQCDTFIGYPCNMHFDYTPLFPFLAYPVNNVGDPFASSSYRIHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKPYVEKIARSIEYIGTLDTTISGSRNGITPLFLWYAVKQAGRDGFKRRVARCLDNARYTVEQFKRIGVEAMRNPCAITVVFPKPPQSVLEKWQIATEGDDAHICLMPSTTRQHVDELIADIAAANKEAAAPSDTAK

SEQ ID NO: 513 - DNA, 1167 bp, Artificial Sequence
  Variant of Leucine Decarboxylase from Planctomycetaceae bacterium
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctagctccagttatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctcgcacgattgaatatatcggtaccctggacactacgatttcgggcagccgtaatggtattacaccgctgtttctttggtacgcggtgaaacaagctggacgcgatggcttcaaacgtcgtgttgcgcgctgtctggataacgcccgctatacggtcgagcagtttaaacgcatcggtgtagaagcgatgcgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagaagcttcggcaccgagcgatacggccaag

SEQ ID NO: 514 - protein, 389 aa, Artificial Sequence
  Variant of Leucine Decarboxylase from Planctomycetaceae bacterium
MGNLKFPDGALSPTDRRRLEDVYQYVREQCDTFIGYPCNMHFDYTPLFPFLAYPVNNVGDPFASSSYRIHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKPYVEKIARTIEYIGTLDTTISGSRNGITPLFLWYAVKQAGRDGFKRRVARCLDNARYTVEQFKRIGVEAMRNPCAITVVFPKPPQSVLEKWQIATEGDDAHICLMPSTTRQHVDELIADIAAANKEASAPSDTAK

SEQ ID NO: 515 - DNA, 1167 bp, Artificial Sequence
  Variant of Leucine Decarboxylase from Planctomycetaceae bacterium
atgggtatgctgaaatttccagatggcgcgttgagcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctagctccagttatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagcgcattgctcgcacgattgaatatatcggtaccctggacactacgatttcgggcagccgtaatggtattacaccgctgtttctttggtacgcggtgaaacaagctggacgcgatggcttcaaacgtcgtgttgcgcgctgtctggataacgcccgctatacggtcgagcagtttaaacgcatcggtgtagaagcgtcgcgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagaagctgcggcaccgagcgatacggccaag

SEQ ID NO: 516 - protein, 389 aa, Artificial Sequence
  Variant of Leucine Decarboxylase from Planctomycetaceae bacterium
MGMLKFPDGALSPTDRRRLEDVYQYVREQCDTFIGYPCNMHFDYTPLFPFLAYPVNNVGDPFASSSYRIHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKPYVERIARTIEYIGTLDTTISGSRNGITPLFLWYAVKQAGRDGFKRRVARCLDNARYTVEQFKRIGVEASRNPCAITVVFPKPPQSVLEKWQIATEGDDAHICLMPSTTRQHVDELIADIAAANKEAAAPSDTAK

SEQ ID NO: 517 - DNA, 1167 bp, Artificial Sequence
  Variant of Leucine Decarboxylase from Planctomycetaceae bacterium
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctagctccagttatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctcgcagcattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagaagctgcggcaccgagcgatacggccaag

SEQ ID NO: 518 - protein, 389 aa, Artificial Sequence
  Variant of Leucine Decarboxylase from Planctomycetaceae bacterium
MGNLKFPDGALSPTDRRRLEDVYQYVREQCDTFIGYPCNMHFDYTPLFPFLAYPVNNVGDPFASSSYRIHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKPYVEKIARSIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTRQHVDELIADIAAANKEAAAPSDTAK

SEQ ID NO: 519 - DNA, 1167 bp, Artificial Sequence
  Variant of Leucine Decarboxylase from Planctomycetaceae bacterium
atgggtatgctgaaatttccagatggcgcgttgagcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctagctccagttatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcgcgctgtctggataacgcccgctatacggtcgagcagtttaaacgcatcggtgtagaagcgtcgcgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagaagctgcggcaccgagcgatacggccaag

SEQ ID NO: 520 - protein, 389 aa, Artificial Sequence
  Variant of Leucine Decarboxylase from Planctomycetaceae bacterium
MGMLKFPDGALSPTDRRRLEDVYQYVREQCDTFIGYPCNMHFDYTPLFPFLAYPVNNVGDPFASSSYRIHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKPYVERIARSIEYIGTLDTTISGSRNGITPLFLWYAVKQAGRDGFKRRVARCLDNARYTVEQFKRIGVEASRNPCAITVVFPKPPQSVLEKWQIATEGDDAHICLMPSTTRQHVDELIADIAAANKEAAAPSDTAK

SEQ ID NO: 521 - DNA, 1167 bp, Artificial Sequence
  Variant of Leucine Decarboxylase from Planctomycetaceae bacterium
atgggtatgctgaaatttccagatggcgcgttgagcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctagctccagttatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctcgcacgattgaatatatcggtaccctggacactacgatttcgggcagccgtaatggtattacaccgctgtttctttggtacgcggtgaaacaagctggacgcgatggcttcaaacgtcgtgttgcgcgctgtctggataacgcccgctatacggtcgagcagtttaaacgcatcggtgtagaagcgatgcgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagaagctgcggcaccgagcgatacggccaag

SEQ ID NO: 522 - protein, 389 aa, Artificial Sequence
  Variant of Leucine Decarboxylase from Planctomycetaceae bacterium
MGMLKFPDGALSPTDRRRLEDVYQYVREQCDTFIGYPCNMHFDYTPLFPFLAYPVNNVGDPFASSSYRIHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKPYVEKIARTIEYIGTLDTTISGSRNGITPLFLWYAVKQAGRDGFKRRVARCLDNARYTVEQFKRIGVEAMRNPCAITVVFPKPPQSVLEKWQIATEGDDAHICLMPSTTRQHVDELIADIAAANKEAAAPSDTAK

SEQ ID NO: 523 - DNA, 1167 bp, Artificial Sequence
  Variant of Leucine Decarboxylase from Planctomycetaceae bacterium
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctagctccagttatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagcgcattgctcgcacgattgaatatatcggtaccctggacactacgatttcgggcagccgtaatggtattacaccgctgtttctttggtacgcggtgaaacaagctggacgcgatggcttcaaacgtcgtgttgcgcgctgtctggataacgcccgctatacggtcgagcagtttaaacgcatcggtgtagaagcgtcgcgtaatccatgcgccattaccgttgtgttcccgaaacctccggcctcagtgctggaaaagtggcaaatcgcaaccgagggcgacgatgcgcatatttgcttaatgccaagtaccacccgtcagcatgtcgatgaattgatcgctgacattgcggccgccaataaagaagctgcggcaccgagcgatacggccaag

SEQ ID NO: 524 - protein, 389 aa, Artificial Sequence
  Variant of Leucine Decarboxylase from Planctomycetaceae bacterium
MGNLKFPDGALSPTDRRRLEDVYQYVREQCDTFIGYPCNMHFDYTPLFPFLAYPVNNVGDPFASSSYRIHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKPYVERIARTIEYIGTLDTTISGSRNGITPLFLWYAVKQAGRDGFKRRVARCLDNARYTVEQFKRIGVEASRNPCAITVVFPKPPASVLEKWQIATEGDDAHICLMPSTTRQHVDELIADIAAANKEAAAPSDTAK

SEQ ID NO: 525 - DNA, 1167 bp, Artificial Sequence
  Variant of Leucine Decarboxylase from Planctomycetaceae bacterium
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctagctccagttatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctcgcacgattgaatatatcggtaccctggacactacgatttcgggcagccgtaatggtattacaccgctgtttctttggtacgcggtgaaacaagctggacgcgatggcttcaaacgtcgtgttgcgcgctgtctggataacgcccgctatacggtcgagcagtttaaacgcatcggtgtagaagcgtcgcgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaggaagcttcggcaccgagcgatacggccaag

SEQ ID NO: 526 - protein, 389 aa, Artificial Sequence
  Variant of Leucine Decarboxylase from Planctomycetaceae bacterium
MGNLKFPDGALSPTDRRRLEDVYQYVREQCDTFIGYPCNMHFDYTPLFPFLAYPVNNVGDPFASSSYRIHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKPYVEKIARTIEYIGTLDTTISGSRNGITPLFLWYAVKQAGRDGFKRRVARCLDNARYTVEQFKRIGVEASRNPCAITVVFPKPPQSVLEKWQIATEGDDAHICLMPSTTRQHVDELIADIAAANKEASAPSDTAK

SEQ ID NO: 527 - DNA, 1167 bp, Artificial Sequence
  Variant of Leucine Decarboxylase from Planctomycetaceae bacterium
atgggtatgctgaaatttccagatggcgcgttgagcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctagctccagttatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctcgcagcattgaatatatcggtaccctggacactacgatttcgggcagccgtaatggtattacaccgctgtttctttggtacgcggtgaaacaagctggacgcgatggcttcaaacgtcgtgttgcgcgctgtctggataacgcccgctatacggtcgagcagtttaaacgcatcggtgtagaagcgtcgcgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagaagcttcggcaccgagcgatacggccaag

SEQ ID NO: 528 - protein, 389 aa, Artificial Sequence
  Variant of Leucine Decarboxylase from Planctomycetaceae bacterium
MGMLKFPDGALSPTDRRRLEDVYQYVREQCDTFIGYPCNMHFDYTPLFPFLAYPVNNVGDPFASSSYRIHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKPYVEKIARSIEYIGTLDTTISGSRNGITPLFLWYAVKQAGRDGFKRRVARCLDNARYTVEQFKRIGVEASRNPCAITVVFPKPPQSVLEKWQIATEGDDAHICLMPSTTRQHVDELIADIAAANKEASAPSDTAK

SEQ ID NO: 529 - DNA, 1167 bp, Artificial Sequence
  Variant of Leucine Decarboxylase from Planctomycetaceae bacterium
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctagctccagttatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagcgcattgctcgcacgattgaatatatcggtaccctggacactacgatttcgggcagccgtaatggtattacaccgctgtttctttggtacgcggtgaaacaagctggacgcgatggcttcaaacgtcgtgttgcgcgctgtctggataacgcccgctatacggtcgagcagtttaaacgcatcggtgtagaagcgatgcgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagaagctgcggcaccgagcgatacggccaag

SEQ ID NO: 530 - protein, 389 aa, Artificial Sequence
  Variant of Leucine Decarboxylase from Planctomycetaceae bacterium
MGNLKFPDGALSPTDRRRLEDVYQYVREQCDTFIGYPCNMHFDYTPLFPFLAYPVNNVGDPFASSSYRIHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKPYVERIARTIEYIGTLDTTISGSRNGITPLFLWYAVKQAGRDGFKRRVARCLDNARYTVEQFKRIGVEAMRNPCAITVVFPKPPQSVLEKWQIATEGDDAHICLMPSTTRQHVDELIADIAAANKEAAAPSDTAK

SEQ ID NO: 531 - DNA, 1167 bp, Artificial Sequence
  Variant of Leucine Decarboxylase from Planctomycetaceae bacterium
atgggtatgctgaaatttccagatggcgcgttgagcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctagctccagttatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagcgtattgctcgcagcattgaatatatcggtaccctggacactacgatttcgggcagccgtaatggtattacaccgctgtttctttggtacgcggtgaaacaagctggacgcgatggcttcaaacgtcgtgttgcgcgctgtctggataacgcccgctatacggtcgagcagtttaaacgcatcggtgtagaagcgatgcgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagaagctgcggcaccgagcgatacggccaag

SEQ ID NO: 532 - protein, 389 aa, Artificial Sequence
  Variant of Leucine Decarboxylase from Planctomycetaceae bacterium
MGMLKFPDGALSPTDRRRLEDVYQYVREQCDTFIGYPCNMHFDYTPLFPFLAYPVNNVGDPFASSSYRIHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKPYVERIARSIEYIGTLDTTISGSRNGITPLFLWYAVKQAGRDGFKRRVARCLDNARYTVEQFKRIGVEAMRNPCAITVVFPKPPQSVLEKWQIATEGDDAHICLMPSTTRQHVDELIADIAAANKEAAAPSDTAK

SEQ ID NO: 533 - DNA, 1167 bp, Artificial Sequence
  Variant of Leucine Decarboxylase from Planctomycetaceae bacterium
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctagctccagttatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagcgtattgctcgcagcattgaatatatcggtaccctggacactacgatttcgggcagccgtaatggtattacaccgctgtttctttggtacgcggtgaaacaagctggacgcgatggcttcaaacgtcgtgttgcgcgctgtctggataacgcccgctatacggtcgagcagtttaaacgcatcggtgtagaagcgatgcgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagaagctgcggcaccgagcgatacggccaag

SEQ ID NO: 534 - protein, 389 aa, Artificial Sequence
  Variant of Leucine Decarboxylase from Planctomycetaceae bacterium
MGNLKFPDGALSPTDRRRLEDVYQYVREQCDTFIGYPCNMHFDYTPLFPFLAYPVNNVGDPFASSSYRIHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKPYVERIARSIEYIGTLDTTISGSRNGITPLFLWYAVKQAGRDGFKRRVARCLDNARYTVEQFKRIGVEAMRNPCAITVVFPKPPQSVLEKWQIATEGDDAHICLMPSTTRQHVDELIADIAAANKEAAAPSDTAK

SEQ ID NO: 535 - DNA, 1167 bp, Artificial Sequence
  Variant of Leucine Decarboxylase from Planctomycetaceae bacterium
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctagctccagttatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctcgcacgattgaatatatcggtaccctggacactacgatttcgggcagccgtaatggtattacaccgctgtttctttggtacgcggtgaaacaagctggacgcgatggcttcaaacgtcgtgttgcgcgctgtctggataacgcccgctatacggtcgagcagtttaaacgcatcggtgtagaagcgatgcgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaatgatgaagctgcagcaccgagcgatacggccaag

SEQ ID NO: 536 - protein, 389 aa, Artificial Sequence
  Variant of Leucine Decarboxylase from Planctomycetaceae bacterium
MGNLKFPDGALSPTDRRRLEDVYQYVREQCDTFIGYPCNMHFDYTPLFPFLAYPVNNVGDPFASSSYRIHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKPYVEKIARTIEYIGTLDTTISGSRNGITPLFLWYAVKQAGRDGFKRRVARCLDNARYTVEQFKRIGVEAMRNPCAITVVFPKPPQSVLEKWQIATEGDDAHICLMPSTTRQHVDELIADIAAANDEAAAPSDTAK

SEQ ID NO: 537 - DNA, 1167 bp, Artificial Sequence
  Variant of Leucine Decarboxylase from Planctomycetaceae bacterium
atgggtatgctgaaatttccagatggcgcgttgagcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctagctccagttatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctcgcagcattgaatatatcggtaccctggacactacgatttcgggcagccgtaatggtattacaccgctgtttctttggtacgcggtgaaacaagctggacgcgatggcttcaaacgtcgtgttgcgcgctgtctggataacgcccgctatacggtcgagcagtttaaacgcatcggtgtagaagcgatgcgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagaagcttcggcaccgagcgatacggccaag

SEQ ID NO: 538 - protein, 389 aa, Artificial Sequence
  Variant of Leucine Decarboxylase from Planctomycetaceae bacterium
MGMLKFPDGALSPTDRRRLEDVYQYVREQCDTFIGYPCNMHFDYTPLFPFLAYPVNNVGDPFASSSYRIHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKPYVEKIARSIEYIGTLDTTISGSRNGITPLFLWYAVKQAGRDGFKRRVARCLDNARYTVEQFKRIGVEAMRNPCAITVVFPKPPQSVLEKWQIATEGDDAHICLMPSTTRQHVDELIADIAAANKEASAPSDTAK

SEQ ID NO: 539 - DNA, 1167 bp, Artificial Sequence
  Variant of Leucine Decarboxylase from Planctomycetaceae bacterium
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctagctccagttatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctcgcagcattgaatatatcggtaccctggacactacgatttcgggcagccgtaatggtattacaccgctgtttctttggtacgcggtgaaacaagctggacgcgatggcttcaaacgtcgtgttgcgcgctgtctggataacgcccgctatacggtcgagcagtttaaacgcatcggtgtagaagcgtcgcgtaatccatgcgccattaccgttgtgttcccgaaacctccggcctcagtgctggaaaagtggcaaatcgcaaccgagggcgacgatgcgcatatttgcttaatgccaagtaccacccgtcagcatgtcgatgaattgatcgctgacattgcggccgccaataaagaagcttcggcaccgagcgatacggccaag

SEQ ID NO: 540 - protein, 389 aa, Artificial Sequence
  Variant of Leucine Decarboxylase from Planctomycetaceae bacterium
MGNLKFPDGALSPTDRRRLEDVYQYVREQCDTFIGYPCNMHFDYTPLFPFLAYPVNNVGDPFASSSYRIHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKPYVEKIARSIEYIGTLDTTISGSRNGITPLFLWYAVKQAGRDGFKRRVARCLDNARYTVEQFKRIGVEASRNPCAITVVFPKPPASVLEKWQIATEGDDAHICLMPSTTRQHVDELIADIAAANKEASAPSDTAK

SEQ ID NO: 541 - DNA, 1167 bp, Artificial Sequence
  Variant of Leucine Decarboxylase from Planctomycetaceae bacterium
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctagctccagttatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctcgcacgattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagaagctgcggcaccgagcgatacggccaag

SEQ ID NO: 542 - protein, 389 aa, Artificial Sequence
  Variant of Leucine Decarboxylase from Planctomycetaceae bacterium
MGNLKFPDGALSPTDRRRLEDVYQYVREQCDTFIGYPCNMHFDYTPLFPFLAYPVNNVGDPFASSSYRIHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKPYVEKIARTIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTRQHVDELIADIAAANKEAAAPSDTAK

SEQ ID NO: 543 - DNA, 1167 bp, Artificial Sequence
  Variant of Leucine Decarboxylase from Planctomycetaceae bacterium
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctagctccagttatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctcgcagcattgaatatatcggtaccctggacactacgatttcgggcagccgtaatggtattacaccgctgtttctttggtacgcggtgaaacaagctggacgcgatggcttcaaacgtcgtgttgcgcgctgtctggataacgcccgctatacggtcgagcagtttaaacgcatcggtgtagaagcgatgcgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaggaagcttcggcaccgagcgatacggccaag

SEQ ID NO: 544 - protein, 389 aa, Artificial Sequence
  Variant of Leucine Decarboxylase from Planctomycetaceae bacterium
MGNLKFPDGALSPTDRRRLEDVYQYVREQCDTFIGYPCNMHFDYTPLFPFLAYPVNNVGDPFASSSYRIHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKPYVEKIARSIEYIGTLDTTISGSRNGITPLFLWYAVKQAGRDGFKRRVARCLDNARYTVEQFKRIGVEAMRNPCAITVVFPKPPQSVLEKWQIATEGDDAHICLMPSTTRQHVDELIADIAAANKEASAPSDTAK

SEQ ID NO: 545 - DNA, 1167 bp, Artificial Sequence
  Variant of Leucine Decarboxylase from Planctomycetaceae bacterium
atgggtatgctgaaatttccagatggcgcgttgagcccgaccgaccgccgccgcctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctagctccagttatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagcgcattgctcgcacgattgaatatatcggtaccctggacactacgatttcgggcagccgtaatggtattacaccgctgtttctttggtacgcggtgaaacaagctggacgcgatggcttcaaacgtcgtgttgcgcgctgtctggataacgcccgctatacggtcgagcagtttaaacgcatcggtgtagaagcgtcgcgtaatccatgcgccattaccgttgtgttcccgaaacctccggcctcagtgctggaaaagtggcaaatcgcaaccgagggcgacgatgcgcatatttgcttaatgccaagtaccacccgtcagcatgtcgatgaattgatcgctgacattgcggccgccaataaagaagctgcggcaccgagcgatacggccaag

SEQ ID NO: 546 - protein, 389 aa, Artificial Sequence
  Variant of Leucine Decarboxylase from Planctomycetaceae bacterium
MGMLKFPDGALSPTDRRRLEDVYQYVREQCDTFIGYPCNMHFDYTPLFPFLAYPVNNVGDPFASSSYRIHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKPYVERIARTIEYIGTLDTTISGSRNGITPLFLWYAVKQAGRDGFKRRVARCLDNARYTVEQFKRIGVEASRNPCAITVVFPKPPASVLEKWQIATEGDDAHICLMPSTTRQHVDELIADIAAANKEAAAPSDTAK

SEQ ID NO: 547 - DNA, 1167 bp, Artificial Sequence
  Variant of Leucine Decarboxylase from Planctomycetaceae bacterium
atgggtatgctgaaatttccagatggcgcgttgagcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctagctccagttatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgctcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcgcgctgtctggataacgcccgctatacggtcgagcagtttaaacgcatcggtgtagaagcgatgcgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagaagctgcggcaccgagcgatacggccaag

SEQ ID NO: 548 - protein, 389 aa, Artificial Sequence
  Variant of Leucine Decarboxylase from Planctomycetaceae bacterium
MGMLKFPDGALSPTDRRRLEDVYQYVREQCDTFIGYPCNMHFDYTPLFPFLAYPVNNVGDPFASSSYRIHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMLKKLAIHESHIHCDAALAGMTLPFMDDAPAFDFATGIDSLSISGHKFIGSPMPCGIVLTRKPYVERIARSIEYIGTLDTTISGSRNGITPLFLWYAVKQAGRDGFKRRVARCLDNARYTVEQFKRIGVEAMRNPCAITVVFPKPPQSVLEKWQIATEGDDAHICLMPSTTRQHVDELIADIAAANKEAAAPSDTAK

SEQ ID NO: 549 - DNA, 1167 bp, Artificial Sequence
  Variant of Leucine Decarboxylase from Planctomycetaceae bacterium
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctagctccagttatcgcatccatacccgtgaaatcgaacgcgaggttctggcgtggttcgccgaactcatgcatattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaatgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcattggtgtagaagcgatgcgtaatccaaacgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagaagctgcggcaccgagcgatacggccaag

SEQ ID NO: 550 - protein, 389 aa, Artificial Sequence
  Variant of Leucine Decarboxylase from Planctomycetaceae bacterium
MGNLKFPDGALSPTDRRRLEDVYQYVREQCDTFIGYPCNMHFDYTPLFPFLAYPVNNVGDPFASSSYRIHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKPYVERIARSIEYIGTLDTTISGSRNGITPLFLWYAVKQAGRDGFKRRVAACLDNARYTVEQFKRIGVEAMRNPNAITVVFPKPPQSVLEKWQIATEGDDAHICLMPSTTRQHVDELIADIAAANKEAAAPSDTAK

SEQ ID NO: 551 - DNA, 1167 bp, Artificial Sequence
  Variant of Leucine Decarboxylase from Planctomycetaceae bacterium
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctagctccagttatcgcatccatacccgtgaaatcgaacgcgaggttctggcgtggttcgccgaactcatgcgtattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaatgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagcgtattgctcgcagtattgaatatatcggtacccgcgacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcattggtgtagaagcgatgcgtaatccatgtgccattaccgttgtgttcccgaaacctccgcagtcagtgctggaaaagtggcaaatcgcaaccgagggcgacgatgcgcatatttgcttaatgccaagtaccacccgtgagcatgtcgatgaattgatcgctgacattgcggccgccaataaagaagccgcggcaccgagcgatacggccaag

SEQ ID NO: 552 - protein, 389 aa, Artificial Sequence
  Variant of Leucine Decarboxylase from Planctomycetaceae bacterium
MGNLKFPDGALSPTDRRRLEDVYQYVREQCDTFIGYPCNMHFDYTPLFPFLAYPVNNVGDPFASSSYRIHTREIEREVLAWFAELMRIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKPYVERIARSIEYIGTRDTTISGSRNGITPLFLWYAVKQAGRDGFKRRVAACLDNARYTVEQFKRIGVEAMRNPCAITVVFPKPPQSVLEKWQIATEGDDAHICLMPSTTREHVDELIADIAAANKEAAAPSDTAK

SEQ ID NO: 553 - DNA, 1167 bp, Artificial Sequence
  Variant of Leucine Decarboxylase from Planctomycetaceae bacterium
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctagctccagttatcgcatccatacccgtgaaatcgaacgcgaggttctggcgtggttcgccgaactcatgcatattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagcgtattgctcgcagtattgaatatatcggtacccgcgacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcattggtgtagaagcgatgcgtaatccaaacgccattaccgttgtgttcccgaaaccttcgcagtcagtgctggaaaagtggcaaatcgcaaccgagggcgacgatgcgcatatttgcttaatgccaagtaccacccgtcagcatgtcgatgaattgatcgctgacattgcggccgccaataaagaagctgcggcaccgagcgatacggccaag

SEQ ID NO: 554 - protein, 389 aa, Artificial Sequence
  Variant of Leucine Decarboxylase from Planctomycetaceae bacterium
MGNLKFPDGALSPTDRRRLEDVYQYVREQCDTFIGYPCNMHFDYTPLFPFLAYPVNNVGDPFASSSYRIHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKPYVERIARSIEYIGTRDTTISGSRNGITPLFLWYAVKQAGRDGFKRRVAACLDNARYTVEQFKRIGVEAMRNPNAITVVFPKPSQSVLEKWQIATEGDDAHICLMPSTTRQHVDELIADIAAANKEAAAPSDTAK

SEQ ID NO: 555 - DNA, 1167 bp, Artificial Sequence
  Variant of Leucine Decarboxylase from Planctomycetaceae bacterium
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctagctccagttatcgcatccatacccgtgaaatcgaacgcgaggttctggcgtggttcgccgaactcatgcatattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagcgtattgctcgcagtattgaatatatcggtacccgcgacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcattggtgtagaagcgatgcgtaatccaaacgccattaccgttgtgttcccgaaaccttcgcagtcagtgctggaaaagtggcaaatcgcaaccgagggcgacgatgcgcatatttgcttaatgccaagtaccacccgtgagcatgtcgatgaattgatcgctgacattgcggccgccaataaagaagctgcggcaccgagcgatacggccaag

SEQ ID NO: 556 - protein, 389 aa, Artificial Sequence
  Variant of Leucine Decarboxylase from Planctomycetaceae bacterium
MGNLKFPDGALSPTDRRRLEDVYQYVREQCDTFIGYPCNMHFDYTPLFPFLAYPVNNVGDPFASSSYRIHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKPYVERIARSIEYIGTRDTTISGSRNGITPLFLWYAVKQAGRDGFKRRVAACLDNARYTVEQFKRIGVEAMRNPNAITVVFPKPSQSVLEKWQIATEGDDAHICLMPSTTREHVDELIADIAAANKEAAAPSDTAK

SEQ ID NO: 557 - DNA, 1167 bp, Artificial Sequence
  Variant of Leucine Decarboxylase from Planctomycetaceae bacterium
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctagctccagttatcgcatccatacccgtgaaatcgaacgcgaggttctggcgtggttcgccgaactcatgcatattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggtgatctctacgaaactatgcgcgctcatcgtgattgcccgccgatcatcttcgctaacattggtacgacgatgaccgaaggcattgacaatgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagcgtattgctcgcagtattgaatatatcggtacccgcgacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagaagctgcggcaccgagcgatacggccaag

SEQ ID NO: 558 - protein, 389 aa, Artificial Sequence
  Variant of Leucine Decarboxylase from Planctomycetaceae bacterium
MGNLKFPDGALSPTDRRRLEDVYQYVREQCDTFIGYPCNMHFDYTPLFPFLAYPVNNVGDPFASSSYRIHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKPYVERIARSIEYIGTRDTTISGSRNGITPLFLWYAVKQAGRDGFKRRVAACLDNARYTVEQFKRIGVEAMRNPCAITVVFPKPPQSVLEKWQIATEGDDAHICLMPSTTRQHVDELIADIAAANKEAAAPSDTAK

SEQ ID NO: 559 - DNA, 1167 bp, Artificial Sequence
  Variant of Leucine Decarboxylase from Planctomycetaceae bacterium
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctagctccagttatcgcatccatacccgtgaaatcgaacgcgaggttctggcgtggttcgccgaactcatgcatattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggtgatctctacgaaactatgcgcgctcatcgtgattgcccgccgatcatcttcgctaacattggtacgacgatgaccgaaggcattgacaacgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagcgtattgctcgcagtattgaatatatcggtacccgcgacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcgcaggtgtagaagcgatgcgtaatccatgtgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagaagctgcggcaccgagcgatacggccaag

SEQ ID NO: 560 - protein, 389 aa, Artificial Sequence
  Variant of Leucine Decarboxylase from Planctomycetaceae bacterium
MGNLKFPDGALSPTDRRRLEDVYQYVREQCDTFIGYPCNMHFDYTPLFPFLAYPVNNVGDPFASSSYRIHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKPYVERIARSIEYIGTRDTTISGSRNGITPLFLWYAVKQAGRDGFKRRVAACLDNARYTVEQFKRAGVEAMRNPCAITVVFPKPPQSVLEKWQIATEGDDAHICLMPSTTRQHVDELIADIAAANKEAAAPSDTAK

SEQ ID NO: 561 - DNA, 1167 bp, Artificial Sequence
  Variant of Leucine Decarboxylase from Planctomycetaceae bacterium
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctagctccagttatcgcatccatacccgtgaaatcgaacgcgaggttctggcgtggttcgccgaactcatgcgtattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccaaacgccattaccgttgtgttcccgaaacctccgcagtcagtgctggaaaagtggcaaatcgcaaccgagggcgacgatgcgcatatttgcttaatgccaagtaccacccgtgagcatgtcgatgaattgatcgctgacattgcggccgccaataaagaagccgcggcaccgagcgatacggccaag

SEQ ID NO: 562 - protein, 389 aa, Artificial Sequence
  Variant of Leucine Decarboxylase from Planctomycetaceae bacterium
MGNLKFPDGALSPTDRRRLEDVYQYVREQCDTFIGYPCNMHFDYTPLFPFLAYPVNNVGDPFASSSYRIHTREIEREVLAWFAELMRIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKPYVERIARSIEYIGTLDTTISGSRNGITPLFLWYAVKQAGRDGFKRRVAACLDNARYTVEQFKRIGVEAMRNPNAITVVFPKPPQSVLEKWQIATEGDDAHICLMPSTTREHVDELIADIAAANKEAAAPSDTAK

SEQ ID NO: 563 - DNA, 1167 bp, Artificial Sequence
  Variant of Leucine Decarboxylase from Planctomycetaceae bacterium
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctagctccagttatcgcatccatacccgtgaaatcgaacgcgaggttctggcgtggttcgccgaactcatgcatattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgcgccattaccgttgtgttcccgaaacctccgcagtcagtgctggaaaagtggcaaatcgcaaccgagggcgacgatgcgcatatttgcttaatgccaagtaccacccgtgagcatgtcgatgaattgatcgctgacattgcggccgccaataaagaagctgcggcaccgagcgatacggccaag

SEQ ID NO: 564 - protein, 389 aa, Artificial Sequence
  Variant of Leucine Decarboxylase from Planctomycetaceae bacterium
MGNLKFPDGALSPTDRRRLEDVYQYVREQCDTFIGYPCNMHFDYTPLFPFLAYPVNNVGDPFASSSYRIHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKPYVERIARSIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTREHVDELIADIAAANKEAAAPSDTAK

SEQ ID NO: 565 - DNA, 1167 bp, Artificial Sequence
  Variant of Leucine Decarboxylase from Planctomycetaceae bacterium
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctagctccagttatcgcatccatacccgtgaaatcgaacgcgaggttctggcgtggttcgccgaactcatgcatattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgataaaccgccgatcatcttcgctaacattggtacgacgatgaccgaaggcattgacaatgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagcgtattgctcgcagtattgaatatatcggtacccgcgacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcattggtgtagaagcgatgcgtaatccaaacgccattaccgttgtgttcccgaaaccttcgcagtcagtgctggaaaagtggcaaatcgcaaccgagggcgacgatgcgcatatttgcttaatgccaagtaccacccgtcagcatgtcgatgaattgatcgctgacattgcggccgccaataaagaagccgcggcaccgagcgatacggccaag

SEQ ID NO: 566 - protein, 389 aa, Artificial Sequence
  Variant of Leucine Decarboxylase from Planctomycetaceae bacterium
MGNLKFPDGALSPTDRRRLEDVYQYVREQCDTFIGYPCNMHFDYTPLFPFLAYPVNNVGDPFASSSYRIHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDKPPIIFANIGTTMTEGIDNVRTIQDMFKKLAIHESHIHCDAALAGMTLPFMDDAPAFDFATGIDSLSISGHKFIGSPMPCGIVLTRKPYVERIARSIEYIGTRDTTISGSRNGITPLFLWYAVKQAGRDGFKRRVAACLDNARYTVEQFKRIGVEAMRNPNAITVVFPKPSQSVLEKWQIATEGDDAHICLMPSTTRQHVDELIADIAAANKEAAAPSDTAK

SEQ ID NO: 567 - DNA, 1167 bp, Artificial Sequence
  Variant of Leucine Decarboxylase from Planctomycetaceae bacterium
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctagctccagttatcgcatccatacccgtgaaatcgaacgcgaggttctggcgtggttcgccgaactcatgcgtattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaatgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagcgtattgctcgcagtattgaatatatcggtacccgcgacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagaagccgcggcaccgagcgatacggccaag

SEQ ID NO: 568 - protein, 389 aa, Artificial Sequence
  Variant of Leucine Decarboxylase from Planctomycetaceae bacterium
MGNLKFPDGALSPTDRRRLEDVYQYVREQCDTFIGYPCNMHFDYTPLFPFLAYPVNNVGDPFASSSYRIHTREIEREVLAWFAELMRIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKPYVERIARSIEYIGTRDTTISGSRNGITPLFLWYAVKQAGRDGFKRRVAACLDNARYTVEQFKRIGVEAMRNPCAITVVFPKPPQSVLEKWQIATEGDDAHICLMPSTTRQHVDELIADIAAANKEAAAPSDTAK

SEQ ID NO: 569 - DNA, 1167 bp, Artificial Sequence
  Variant of Leucine Decarboxylase from Planctomycetaceae bacterium
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctagctccagttatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagcgtattgctgggagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagaagctgcggcaccgagcgatacggccaag

SEQ ID NO: 570 - protein, 389 aa, Artificial Sequence
  Variant of Leucine Decarboxylase from Planctomycetaceae bacterium
MGNLKFPDGALSPTDRRRLEDVYQYVREQCDTFIGYPCNMHFDYTPLFPFLAYPVNNVGDPFASSSYRIHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKPYVERIAGSIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTRQHVDELIADIAAANKEAAAPSDTAK

SEQ ID NO: 571 - DNA, 1167 bp, Artificial Sequence
  Variant of Leucine Decarboxylase from Planctomycetaceae bacterium
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctagctccagttatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgcgggaaggcattgacaacgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagaagctgcggcaccgagcgatacggccaag

SEQ ID NO: 572 - protein, 389 aa, Artificial Sequence
  Variant of Leucine Decarboxylase from Planctomycetaceae bacterium
MGNLKFPDGALSPTDRRRLEDVYQYVREQCDTFIGYPCNMHFDYTPLFPFLAYPVNNVGDPFASSSYRIHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMREGIDNVRTIQDMFKKLAIHESHIHCDAALAGMTLPFMDDAPAFDFATGIDSLSISGHKFIGSPMPCGIVLTRKPYVERIARSIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTRQHVDELIADIAAANKEAAAPSDTAK

SEQ ID NO: 573 - DNA, 1167 bp, Artificial Sequence
  Variant of Leucine Decarboxylase from Planctomycetaceae bacterium
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctagctccagttatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgcgccattaccgttgtgttcccgaaacctccgcagtcagtgctggaaaagtggcaaatcgcaaccgagggcgacgatgcgcatatttgcttaatgccaagtaccacccgtcagactgtcgatgaattgatcgctgacattgcggccgccaataaagaagctgcggcaccgagcgatacggccaag

SEQ ID NO: 574 - protein, 389 aa, Artificial Sequence
  Variant of Leucine Decarboxylase from Planctomycetaceae bacterium
MGNLKFPDGALSPTDRRRLEDVYQYVREQCDTFIGYPCNMHFDYTPLFPFLAYPVNNVGDPFASSSYRIHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKPYVERIARSIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTRQTVDELIADIAAANKEAAAPSDTAK

SEQ ID NO: 575 - DNA, 1167 bp, Artificial Sequence
  Variant of Leucine Decarboxylase from Planctomycetaceae bacterium
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctagctccagttatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgcgccattaccgttgtgttcccgaaacctccgcagtcagtgctggaaaagtggcaaatcgcaaccgagggcgacgatgcgcatatttgcttaatgccaagtaccacccgtcagcaggtcgatgaattgatcgctgacattgcggccgccaataaagaagctgcggcaccgagcgatacggccaag

SEQ ID NO: 576 - protein, 389 aa, Artificial Sequence
  Variant of Leucine Decarboxylase from Planctomycetaceae bacterium
MGNLKFPDGALSPTDRRRLEDVYQYVREQCDTFIGYPCNMHFDYTPLFPFLAYPVNNVGDPFASSSYRIHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKPYVERIARSIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTRQQVDELIADIAAANKEAAAPSDTAK

SEQ ID NO: 577 - DNA, 1167 bp, Artificial Sequence
  Variant of Leucine Decarboxylase from Planctomycetaceae bacterium
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctagctccagttatcgcatccatacccgtgaaatcgaacgcgaggttctggcgtggttcgccgaactcatgcacattgcaccagaaaagtactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagaagctgcggcaccgagcgatacggccaag

SEQ ID NO: 578 - protein, 389 aa, Artificial Sequence
  Variant of Leucine Decarboxylase from Planctomycetaceae bacterium
MGNLKFPDGALSPTDRRRLEDVYQYVREQCDTFIGYPCNMHFDYTPLFPFLAYPVNNVGDPFASSSYRIHTREIEREVLAWFAELMHIAPEKYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKPYVERIARSIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTRQHVDELIADIAAANKEAAAPSDTAK

SEQ ID NO: 579 - DNA, 1167 bp, Artificial Sequence
  Variant of Leucine Decarboxylase from Planctomycetaceae bacterium
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctagctccagttatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatggttgaaggcattgacaacgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagaagctgcggcaccgagcgatacggccaag

SEQ ID NO: 580 - protein, 389 aa, Artificial Sequence
  Variant of Leucine Decarboxylase from Planctomycetaceae bacterium
MGNLKFPDGALSPTDRRRLEDVYQYVREQCDTFIGYPCNMHFDYTPLFPFLAYPVNNVGDPFASSSYRIHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMVEGIDNVRTIQDMFKKLAIHESHIHCDAALAGMTLPFMDDAPAFDFATGIDSLSISGHKFIGSPMPCGIVLTRKPYVERIARSIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTRQHVDELIADIAAANKEAAAPSDTAK

SEQ ID NO: 581 - DNA, 1167 bp, Artificial Sequence
  Variant of Leucine Decarboxylase from Planctomycetaceae bacterium
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctagctccagttatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgctgaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagaagctgcggcaccgagcgatacggccaag

SEQ ID NO: 582 - protein, 389 aa, Artificial Sequence
  Variant of Leucine Decarboxylase from Planctomycetaceae bacterium
MGNLKFPDGALSPTDRRRLEDVYQYVREQCDTFIGYPCNMHFDYTPLFPFLAYPVNNVGDPFASSSYRIHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMLKKLAIHESHIHCDAALAGMTLPFMDDAPAFDFATGIDSLSISGHKFIGSPMPCGIVLTRKPYVERIARSIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTRQHVDELIADIAAANKEAAAPSDTAK

SEQ ID NO: 583 - DNA, 1167 bp, Artificial Sequence
  Variant of Leucine Decarboxylase from Planctomycetaceae bacterium
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgttttgtagctccagttatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagaagctgcggcaccgagcgatacggccaag

SEQ ID NO: 584 - protein, 389 aa, Artificial Sequence
  Variant of Leucine Decarboxylase from Planctomycetaceae bacterium
MGNLKFPDGALSPTDRRRLEDVYQYVREQCDTFIGYPCNMHFDYTPLFPFLAYPVNNVGDPFCSSSYRIHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKPYVERIARSIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTRQHVDELIADIAAANKEAAAPSDTAK

SEQ ID NO: 585 - DNA, 1167 bp, Artificial Sequence
  Variant of Leucine Decarboxylase from Planctomycetaceae bacterium
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctagctccagttatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttgggtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagaagctgcggcaccgagcgatacggccaag

SEQ ID NO: 586 - protein, 389 aa, Artificial Sequence
  Variant of Leucine Decarboxylase from Planctomycetaceae bacterium
MGNLKFPDGALSPTDRRRLEDVYQYVREQCDTFIGYPCNMHFDYTPLFPFLAYPVNNVGDPFASSSYRIHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKPWVERIARSIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTRQHVDELIADIAAANKEAAAPSDTAK

SEQ ID NO: 587 - DNA, 1167 bp, Artificial Sequence
  Variant of Leucine Decarboxylase from Planctomycetaceae bacterium
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctagctccagttatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacgctgatctctacgaaactatgcgcgctcatcgtgattgcccgccgatcatcttcgctaacattggtacgacgatgaccgaaggcattgacaacgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagaagctgcggcaccgagcgatacggccaag

SEQ ID NO: 588 - protein, 389 aa, Artificial Sequence
  Variant of Leucine Decarboxylase from Planctomycetaceae bacterium
MGNLKFPDGALSPTDRRRLEDVYQYVREQCDTFIGYPCNMHFDYTPLFPFLAYPVNNVGDPFASSSYRIHTREIEREVLAWFAELMHIAPEEYWGYVTNGGSEGNLYGLFLARERFPTGVAYYSEDSHYSVYKNLRLLNMRHIMIKSQPNGEIDYADLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKPYVERIARSIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTRQHVDELIADIAAANKEAAAPSDTAK

SEQ ID NO: 589 - DNA, 1167 bp, Artificial Sequence
  Variant of Leucine Decarboxylase from Planctomycetaceae bacterium
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctagctccagttatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgcgccattaccgttgtgttcccgaaacctccgcagtcagtgctggaaaagtggcaaatcgcaaccgagggcgacgatgcgcatatttgcttaatgccaagtaccacccgtcagatggtcgatgaattgatcgctgacattgcggccgccaataaagaagctgcggcaccgagcgatacggccaag

SEQ ID NO: 590 - protein, 389 aa, Artificial Sequence
  Variant of Leucine Decarboxylase from Planctomycetaceae bacterium
MGNLKFPDGALSPTDRRRLEDVYQYVREQCDTFIGYPCNMHFDYTPLFPFLAYPVNNVGDPFASSSYRIHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKPYVERIARSIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTRQMVDELIADIAAANKEAAAPSDTAK

SEQ ID NO: 591 - DNA, 1167 bp, Artificial Sequence
  Variant of Leucine Decarboxylase from Planctomycetaceae bacterium
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctagctccagttatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagcgtattgctgatagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagaagctgcggcaccgagcgatacggccaag

SEQ ID NO: 592 - protein, 389 aa, Artificial Sequence
  Variant of Leucine Decarboxylase from Planctomycetaceae bacterium
MGNLKFPDGALSPTDRRRLEDVYQYVREQCDTFIGYPCNMHFDYTPLFPFLAYPVNNVGDPFASSSYRIHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKPYVERIADSIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTRQHVDELIADIAAANKEAAAPSDTAK

SEQ ID NO: 593 - DNA, 1167 bp, Artificial Sequence
  Variant of Leucine Decarboxylase from Planctomycetaceae bacterium
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctagctccagttatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagcgtattgctactagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagaagctgcggcaccgagcgatacggccaag

SEQ ID NO: 594 - protein, 389 aa, Artificial Sequence
  Variant of Leucine Decarboxylase from Planctomycetaceae bacterium
MGNLKFPDGALSPTDRRRLEDVYQYVREQCDTFIGYPCNMHFDYTPLFPFLAYPVNNVGDPFASSSYRIHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKPYVERIATSIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTRQHVDELIADIAAANKEAAAPSDTAK

SEQ ID NO: 595 - DNA, 1167 bp, Artificial Sequence
  Variant of Leucine Decarboxylase from Planctomycetaceae bacterium
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctagctccagttatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagcgtattgctcatagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagaagctgcggcaccgagcgatacggccaag

SEQ ID NO: 596 - protein, 389 aa, Artificial Sequence
  Variant of Leucine Decarboxylase from Planctomycetaceae bacterium
MGNLKFPDGALSPTDRRRLEDVYQYVREQCDTFIGYPCNMHFDYTPLFPFLAYPVNNVGDPFASSSYRIHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKPYVERIAHSIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTRQHVDELIADIAAANKEAAAPSDTAK

SEQ ID NO: 597 - DNA, 1167 bp, Artificial Sequence
  Variant of Leucine Decarboxylase from Planctomycetaceae bacterium
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctagctccagttatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgtgtaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagaagctgcggcaccgagcgatacggccaag

SEQ ID NO: 598 - protein, 389 aa, Artificial Sequence
  Variant of Leucine Decarboxylase from Planctomycetaceae bacterium
MGNLKFPDGALSPTDRRRLEDVYQYVREQCDTFIGYPCNMHFDYTPLFPFLAYPVNNVGDPFASSSYRIHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMCKKLAIHESHIHCDAALAGMTLPFMDDAPAFDFATGIDSLSISGHKFIGSPMPCGIVLTRKPYVERIARSIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTRQHVDELIADIAAANKEAAAPSDTAK

SEQ ID NO: 599 - DNA, 1167 bp, Artificial Sequence
  Variant of Leucine Decarboxylase from Planctomycetaceae bacterium
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctagctccagttatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagcttcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagaagctgcggcaccgagcgatacggccaag

SEQ ID NO: 600 - protein, 389 aa, Artificial Sequence
  Variant of Leucine Decarboxylase from Planctomycetaceae bacterium
MGNLKFPDGALSPTDRRRLEDVYQYVREQCDTFIGYPCNMHFDYTPLFPFLAYPVNNVGDPFASSSYRIHTREIEREVLAWFAELMHIAPEEYWGYVTNGGSEGNLYGLFLARERFPTGVAYYSEASHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKPYVERIARSIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTRQHVDELIADIAAANKEAAAPSDTAK

SEQ ID NO: 601 - DNA, 1167 bp, Artificial Sequence
  Variant of Leucine Decarboxylase from Planctomycetaceae bacterium
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctagctccagttatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgcgccattaccgttgtgttcccgaaacctccgcagtcagtgctggaaaagtggcaaatcgcaaccgagggcgcggatgcgcatatttgcttaatgccaagtaccacccgtcagcatgtcgatgaattgatcgctgacattgcggccgccaataaagaagctgcggcaccgagcgatacggccaag

SEQ ID NO: 602 - protein, 389 aa, Artificial Sequence
  Variant of Leucine Decarboxylase from Planctomycetaceae bacterium
MGNLKFPDGALSPTDRRRLEDVYQYVREQCDTFIGYPCNMHFDYTPLFPFLAYPVNNVGDPFASSSYRIHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKPYVERIARSIEYIGTLDTTISGSRNGITPLFLWYAVKQAGRDGFKRRVAACLDNARYTVEQFKRIGVEAMRNPCAITVVFPKPPQSVLEKWQIATEGADAHICLMPSTTRQHVDELIADIAAANKEAAAPSDTAK

SEQ ID NO: 603 - DNA, 1167 bp, Artificial Sequence
  Variant of Leucine Decarboxylase from Planctomycetaceae bacterium
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctagctccagttatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaaactggcgattcacgattctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagaagctgcggcaccgagcgatacggccaag

SEQ ID NO: 604 - protein, 389 aa, Artificial Sequence
  Variant of Leucine Decarboxylase from Planctomycetaceae bacterium
MGNLKFPDGALSPTDRRRLEDVYQYVREQCDTFIGYPCNMHFDYTPLFPFLAYPVNNVGDPFASSSYRIHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHDSHIHCDAALAGMTLPFMDDAPAFDFATGIDSLSISGHKFIGSPMPCGIVLTRKPYVERIARSIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTRQHVDELIADIAAANKEAAAPSDTAK

SEQ ID NO: 605 - DNA, 1167 bp, Artificial Sequence
  Variant of Leucine Decarboxylase from Planctomycetaceae bacterium
atgggtaatctgaaatttccagatggcgcgttgagcccgaccgaccagcgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctagctccagttatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagaagctgcggcaccgagcgatacggccaag

SEQ ID NO: 606 - protein, 389 aa, Artificial Sequence
  Variant of Leucine Decarboxylase from Planctomycetaceae bacterium
MGNLKFPDGALSPTDQRRLEDVYQYVREQCDTFIGYPCNMHFDYTPLFPFLAYPVNNVGDPFASSSYRIHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKPYVERIARSIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTRQHVDELIADIAAANKEAAAPSDTAK

SEQ ID NO: 607 - DNA, 1167 bp, Artificial Sequence
  Variant of Leucine Decarboxylase from Planctomycetaceae bacterium
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctagctccagttatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgcgccattaccgttgtgttcccgaaacctccgcagtcagtgctggaaaagtggcaaatcgcaaccgagggcgacgatgcgcatatttgcttaatgccaagtaccacccgtcagcttgtcgatgaattgatcgctgacattgcggccgccaataaagaagctgcggcaccgagcgatacggccaag

SEQ ID NO: 608 - protein, 389 aa, Artificial Sequence
  Variant of Leucine Decarboxylase from Planctomycetaceae bacterium
MGNLKFPDGALSPTDRRRLEDVYQYVREQCDTFIGYPCNMHFDYTPLFPFLAYPVNNVGDPFASSSYRIHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKPYVERIARSIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTRQLVDELIADIAAANKEAAAPSDTAK

SEQ ID NO: 609 - DNA, 1167 bp, Artificial Sequence
  Variant of Leucine Decarboxylase from Planctomycetaceae bacterium
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctagctccagttatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagcgtattgcttctagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagaagctgcggcaccgagcgatacggccaag

SEQ ID NO: 610 - protein, 389 aa, Artificial Sequence
  Variant of Leucine Decarboxylase from Planctomycetaceae bacterium
MGNLKFPDGALSPTDRRRLEDVYQYVREQCDTFIGYPCNMHFDYTPLFPFLAYPVNNVGDPFASSSYRIHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKPYVERIASSIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTRQHVDELIADIAAANKEAAAPSDTAK

SEQ ID NO: 611 - DNA, 1167 bp, Artificial Sequence
  Variant of Leucine Decarboxylase from Planctomycetaceae bacterium
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctagctccagttatcgcatccatacccgtgaaatcgaacgcgaggttctgaagtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagaagctgcggcaccgagcgatacggccaag

SEQ ID NO: 612 - protein, 389 aa, Artificial Sequence
  Variant of Leucine Decarboxylase from Planctomycetaceae bacterium
MGNLKFPDGALSPTDRRRLEDVYQYVREQCDTFIGYPCNMHFDYTPLFPFLAYPVNNVGDPFASSSYRIHTREIEREVLKWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKPYVERIARSIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTRQHVDELIADIAAANKEAAAPSDTAK

SEQ ID NO: 613 - DNA, 1167 bp, Artificial Sequence
  Variant of Leucine Decarboxylase from Planctomycetaceae bacterium
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctagctccagttatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgcgccattaccgttgtgttcccgaaacctccgcagtcagtgctggaaaagtggcaaatcgcaaccgagggcgacgatgcgcatatttgcttaatgccaagtaccacccgtcaggttgtcgatgaattgatcgctgacattgcggccgccaataaagaagctgcggcaccgagcgatacggccaag

SEQ ID NO: 614 - protein, 389 aa, Artificial Sequence
  Variant of Leucine Decarboxylase from Planctomycetaceae bacterium
MGNLKFPDGALSPTDRRRLEDVYQYVREQCDTFIGYPCNMHFDYTPLFPFLAYPVNNVGDPFASSSYRIHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKPYVERIARSIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTRQVVDELIADIAAANKEAAAPSDTAK

SEQ ID NO: 615 - DNA, 1167 bp, Artificial Sequence
  Variant of Leucine Decarboxylase from Planctomycetaceae bacterium
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctagctccagttatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaaacttcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagaagctgcggcaccgagcgatacggccaag

SEQ ID NO: 616 - protein, 389 aa, Artificial Sequence
  Variant of Leucine Decarboxylase from Planctomycetaceae bacterium
MGNLKFPDGALSPTDRRRLEDVYQYVREQCDTFIGYPCNMHFDYTPLFPFLAYPVNNVGDPFASSSYRIHTREIEREVLAWFAELMHIAPEEYWGYVTNGGSEGNLYGLFLARERFPTGVAYYSETSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKPYVERIARSIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTRQHVDELIADIAAANKEAAAPSDTAK

SEQ ID NO: 617 - DNA, 1167 bp, Artificial Sequence
  Variant of Leucine Decarboxylase from Planctomycetaceae bacterium
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctagctccagttatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaaggaaggcattgacaacgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagaagctgcggcaccgagcgatacggccaag

SEQ ID NO: 618 - protein, 389 aa, Artificial Sequence
  Variant of Leucine Decarboxylase from Planctomycetaceae bacterium
MGNLKFPDGALSPTDRRRLEDVYQYVREQCDTFIGYPCNMHFDYTPLFPFLAYPVNNVGDPFASSSYRIHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMKEGIDNVRTIQDMFKKLAIHESHIHCDAALAGMTLPFMDDAPAFDFATGIDSLSISGHKFIGSPMPCGIVLTRKPYVERIARSIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTRQHVDELIADIAAANKEAAAPSDTAK

SEQ ID NO: 619 - DNA, 1167 bp, Artificial Sequence
  Variant of Leucine Decarboxylase from Planctomycetaceae bacterium
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctagctccagttatcgcatccatacccgtgaaatcgaacgcgaggttctgggttggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagaagctgcggcaccgagcgatacggccaag

SEQ ID NO: 620 - protein, 389 aa, Artificial Sequence
  Variant of Leucine Decarboxylase from Planctomycetaceae bacterium
MGNLKFPDGALSPTDRRRLEDVYQYVREQCDTFIGYPCNMHFDYTPLFPFLAYPVNNVGDPFASSSYRIHTREIEREVLGWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKPYVERIARSIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTRQHVDELIADIAAANKEAAAPSDTAK

SEQ ID NO: 621 - DNA, 1167 bp, Artificial Sequence
  Variant of Leucine Decarboxylase from Planctomycetaceae bacterium
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctagctccagttatcgcatccatacccgtgaaatcgaacgcgaggttctggcgtggttcgccgaactcatgcacattgcaccagcggaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagaagctgcggcaccgagcgatacggccaag

SEQ ID NO: 622 - protein, 389 aa, Artificial Sequence
  Variant of Leucine Decarboxylase from Planctomycetaceae bacterium
MGNLKFPDGALSPTDRRRLEDVYQYVREQCDTFIGYPCNMHFDYTPLFPFLAYPVNNVGDPFASSSYRIHTREIEREVLAWFAELMHIAPAEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKPYVERIARSIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTRQHVDELIADIAAANKEAAAPSDTAK

SEQ ID NO: 623 - DNA, 1167 bp, Artificial Sequence
  Variant of Leucine Decarboxylase from Planctomycetaceae bacterium
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctagctccagttatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacgttcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagaagctgcggcaccgagcgatacggccaag

SEQ ID NO: 624 - protein, 389 aa, Artificial Sequence
  Variant of Leucine Decarboxylase from Planctomycetaceae bacterium
MGNLKFPDGALSPTDRRRLEDVYQYVREQCDTFIGYPCNMHFDYTPLFPFLAYPVNNVGDPFASSSYRIHTREIEREVLAWFAELMHIAPEEYWGYVTNGGSEGNLYGLFLARERFPTGVAYYSEDSHYSVYKNLRLLNVRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKPYVERIARSIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTRQHVDELIADIAAANKEAAAPSDTAK

SEQ ID NO: 625 - DNA, 1167 bp, Artificial Sequence
  Variant of Leucine Decarboxylase from Planctomycetaceae bacterium
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctagctccagttatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgcgccattaccgttgtgttcccgaaacctccgcagtcagtgctggaaaagtggcaaatcgcaaccgagggcgacgatgcgcatatttgcttaatgccaagtaccacccgtcaggctgtcgatgaattgatcgctgacattgcggccgccaataaagaagctgcggcaccgagcgatacggccaag

SEQ ID NO: 626 - protein, 389 aa, Artificial Sequence
  Variant of Leucine Decarboxylase from Planctomycetaceae bacterium
MGNLKFPDGALSPTDRRRLEDVYQYVREQCDTFIGYPCNMHFDYTPLFPFLAYPVNNVGDPFASSSYRIHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKPYVERIARSIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTRQAVDELIADIAAANKEAAAPSDTAK

SEQ ID NO: 627 - DNA, 1167 bp, Artificial Sequence
  Variant of Leucine Decarboxylase from Planctomycetaceae bacterium
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctagctccagttatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacagtgatctctacgaaactatgcgcgctcatcgtgattgcccgccgatcatcttcgctaacattggtacgacgatgaccgaaggcattgacaacgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagaagctgcggcaccgagcgatacggccaag

SEQ ID NO: 628 - protein, 389 aa, Artificial Sequence
  Variant of Leucine Decarboxylase from Planctomycetaceae bacterium
MGNLKFPDGALSPTDRRRLEDVYQYVREQCDTFIGYPCNMHFDYTPLFPFLAYPVNNVGDPFASSSYRIHTREIEREVLAWFAELMHIAPEEYWGYVTNGGSEGNLYGLFLARERFPTGVAYYSEDSHYSVYKNLRLLNMRHIMIKSQPNGEIDYSDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKPYVERIARSIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTRQHVDELIADIAAANKEAAAPSDTAK

SEQ ID NO: 629 - DNA, 1167 bp, Artificial Sequence
  Variant of Leucine Decarboxylase from Planctomycetaceae bacterium
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctagctccagttatcgcatccatacccgtgaaatcgaacgcttggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagaagctgcggcaccgagcgatacggccaag

SEQ ID NO: 630 - protein, 389 aa, Artificial Sequence
  Variant of Leucine Decarboxylase from Planctomycetaceae bacterium
MGNLKFPDGALSPTDRRRLEDVYQYVREQCDTFIGYPCNMHFDYTPLFPFLAYPVNNVGDPFASSSYRIHTREIERLVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKPYVERIARSIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTRQHVDELIADIAAANKEAAAPSDTAK

SEQ ID NO: 631 - DNA, 1167 bp, Artificial Sequence
  Variant of Leucine Decarboxylase from Planctomycetaceae bacterium
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctagctccagttatcgcatccatacccgtgaaatcgaacgcgaggttctggcgtggttcgccgaactcatgcacattgcaccacaggaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagaagctgcggcaccgagcgatacggccaag

SEQ ID NO: 632 - protein, 389 aa, Artificial Sequence
  Variant of Leucine Decarboxylase from Planctomycetaceae bacterium
MGNLKFPDGALSPTDRRRLEDVYQYVREQCDTFIGYPCNMHFDYTPLFPFLAYPVNNVGDPFASSSYRIHTREIEREVLAWFAELMHIAPQEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKPYVERIARSIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTRQHVDELIADIAAANKEAAAPSDTAK

SEQ ID NO: 633 - DNA, 1167 bp, Artificial Sequence
  Variant of Leucine Decarboxylase from Planctomycetaceae bacterium
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctagctccagttatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagcgtattgctattagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagaagctgcggcaccgagcgatacggccaag

SEQ ID NO: 634 - protein, 389 aa, Artificial Sequence
  Variant of Leucine Decarboxylase from Planctomycetaceae bacterium
MGNLKFPDGALSPTDRRRLEDVYQYVREQCDTFIGYPCNMHFDYTPLFPFLAYPVNNVGDPFASSSYRIHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKPYVERIAISIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTRQHVDELIADIAAANKEAAAPSDTAK

SEQ ID NO: 635 - DNA, 1167 bp, Artificial Sequence
  Variant of Leucine Decarboxylase from Planctomycetaceae bacterium
atgggtaatctgaaatttccagatggcgcgttgagcccgaccgacgttcgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctagctccagttatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagaagctgcggcaccgagcgatacggccaag

SEQ ID NO: 636 - protein, 389 aa, Artificial Sequence
  Variant of Leucine Decarboxylase from Planctomycetaceae bacterium
MGNLKFPDGALSPTDVRRLEDVYQYVREQCDTFIGYPCNMHFDYTPLFPFLAYPVNNVGDPFASSSYRIHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKPYVERIARSIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTRQHVDELIADIAAANKEAAAPSDTAK

SEQ ID NO: 637 - DNA, 1167 bp, Artificial Sequence
  Variant of Leucine Decarboxylase from Planctomycetaceae bacterium
atgggtaatctgaaatttccagatggcgcgttgagcccgaccgaccaacgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctagctccagttatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgtccgccgatcatcttcgctaacattggtacgacgatgaccgaaggcattgacaacgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagcgtattgctactagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgagccgtaatccaaatgccattaccgttgtgttcccgaaacctccgcagtcagtgctggaaaagtggcaaatcgcaaccgagggcgacgatgcgcatatttgcttaatgccaagtaccacccgtcagatggtcgatgaattgatcgctgacattgcggccgccaataaagaagctgcggcaccgagcgatacggccaag

SEQ ID NO: 638 - protein, 389 aa, Artificial Sequence
  Variant of Leucine Decarboxylase from Planctomycetaceae bacterium
MGNLKFPDGALSPTDQRRLEDVYQYVREQCDTFIGYPCNMHFDYTPLFPFLAYPVNNVGDPFASSSYRIHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKPYVERIATSIEYIGTLDTTISGSRNGITPLFLWYAVKQAGRDGFKRRVAACLDNARYTVEQFKRIGVEASRNPNAITVVFPKPPQSVLEKWQIATEGDDAHICLMPSTTRQMVDELIADIAAANKEAAAPSDTAK

SEQ ID NO: 639 - DNA, 1167 bp, Artificial Sequence
  Variant of Leucine Decarboxylase from Planctomycetaceae bacterium
atgggtaatctgaaatttccagatggcgcgttgagcccgaccgaccaacgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgttttgtagctccagttatcgcatccatacccgtgaaatcgaacgcgaggttctgaagtggttcgccgaactcatgcacattgcaccagaagaatactggggttatgtgactaatggaggatcggagggcaacctgtacggtttgtttttagcgcgtgaacgctttcctacgggcgtcgcctactattcggaaacgtcgcattatagcgtgtataagaatctgcgtctgctgaacatgcgtcacatcatgatcaaatcacagccgaatggtgagattgattacggcgatctctacgaaactatgcgcgctcatcgtgattgtccgccgatcatcttcgctaacattggtacgacgatgcgcgaaggcattgacaacgtacgcaccatccaggatatgtgcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgagccgtaatccaaatgccattaccgttgtgttcccgaaacctccgcagtcagtgctggaaaagtggcaaatcgcaaccgagggcgacgatgcgcatatttgcttaatgccaagtaccacccgtcagatggtcgatgaattgatcgctgacattgcggccgccaataaagaagctgcggcaccgagcgatacggccaag

SEQ ID NO: 640 - protein, 389 aa, Artificial Sequence
  Variant of Leucine Decarboxylase from Planctomycetaceae bacterium
MGNLKFPDGALSPTDQRRLEDVYQYVREQCDTFIGYPCNMHFDYTPLFPFLAYPVNNVGDPFCSSSYRIHTREIEREVLKWFAELMHIAPEEYWGYVTNGGSEGNLYGLFLARERFPTGVAYYSETSHYSVYKNLRLLNMRHIMIKSQPNGEIDYGDLYETMRAHRDCPPIIFANIGTTMREGIDNVRTIQDMCKKLAIHESHIHCDAALAGMTLPFMDDAPAFDFATGIDSLSISGHKFIGSPMPCGIVLTRKPYVEKIATSIEYIGTLDTTISGSRNGITPLFLWYAVKQAGRDGFKRRVAACLDNARYTVEQFKRIGVEASRNPNAITVVFPKPPQSVLEKWQIATEGDDAHICLMPSTTRQMVDELIADIAAANKEAAAPSDTAK

SEQ ID NO: 641 - DNA, 1167 bp, Artificial Sequence
  Variant of Leucine Decarboxylase from Planctomycetaceae bacterium
atgggtaatctgaaatttccagatggcgcgttgagcccgaccgaccaacgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctagctccagttatcgcatccatacccgtgaaatcgaacgcgaggttctggcatggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgtccgccgatcatcttcgctaacattggtacgacgatgaccgaaggcattgacaacgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagcgcattgctacttcgattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccaaatgccattaccgttgtgttcccgaaacctccgcagtcagtgctggaaaagtggcaaatcgcaaccgagggcgacgatgcgcatatttgcttaatgccaagtaccacccgtcagatggtcgatgaattgatcgctgacattgcggccgccaataaagaagctgcggcaccgagcgatacggccaag

SEQ ID NO: 642 - protein, 389 aa, Artificial Sequence
  Variant of Leucine Decarboxylase from Planctomycetaceae bacterium
MGNLKFPDGALSPTDQRRLEDVYQYVREQCDTFIGYPCNMHFDYTPLFPFLAYPVNNVGDPFASSSYRIHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKPYVERIATSIEYIGTLDTTISGSRNGITPLFLWYAVKQAGRDGFKRRVAACLDNARYTVEQFKRIGVEAMRNPNAITVVFPKPPQSVLEKWQIATEGDDAHICLMPSTTRQMVDELIADIAAANKEAAAPSDTAK

SEQ ID NO: 643 - DNA, 1167 bp, Artificial Sequence
  Variant of Leucine Decarboxylase from Planctomycetaceae bacterium
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgcaagctccagttatcgcatccatacccgtgaaatcgaacgcgaggttctgaagtggttcgccgaactcatgcacattgcaccagaggaatactggggttatgtgactaatggaggatcggagggcaacctgtacggtttgtttttagcgcgtgaacgctttcctacgggcgtcgcctactattcggaaacgtcgcattatagcgtgtataagaatctgcgtctgctgaacatgcgtcacatcatgatcaaatcacagccgaatggtgagattgattacggcgatctctacgaaactatgcgcgctcatcgtgattgtccgccgatcatcttcgctaacattggtacgacgatgcgcgaaggcattgacaacgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagcgcattgctacttcgattgaatatatcggtacccgtgacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgagccgtaatccatgtgccattaccgttgtgttcccgaaacctccgcagtcagtgctggaaaagtggcaaatcgcaaccgagggcgacgatgcgcatatttgcttaatgccaagtaccacccgtcagatggtcgatgaattgatcgctgacattgcggccgccaataaagaagctgcggcaccgagcgatacggccaag

SEQ ID NO: 644 - protein, 389 aa, Artificial Sequence
  Variant of Leucine Decarboxylase from Planctomycetaceae bacterium
MGNLKFPDGALSPTDRRRLEDVYQYVREQCDTFIGYPCNMHFDYTPLFPFLAYPVNNVGDPFASSSYRIHTREIEREVLKWFAELMHIAPEEYWGYVTNGGSEGNLYGLFLARERFPTGVAYYSETSHYSVYKNLRLLNMRHIMIKSQPNGEIDYGDLYETMRAHRDCPPIIFANIGTTMREGIDNVRTIQDMFKKLAIHESHIHCDAALAGMTLPFMDDAPAFDFATGIDSLSISGHKFIGSPMPCGIVLTRKPYVERIATSIEYIGTRDTTISGSRNGITPLFLWYAVKQAGRDGFKRRVAACLDNARYTVEQFKRIGVEASRNPCAITVVFPKPPQSVLEKWQIATEGDDAHICLMPSTTRQMVDELIADIAAANKEAAAPSDTAK

SEQ ID NO: 645 - DNA, 1167 bp, Artificial Sequence
  Variant of Leucine Decarboxylase from Planctomycetaceae bacterium
atgggtaatctgaaatttccagatggcgcgttgagcccgaccgaccaacgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgcaagctccagttatcgcatccatacccgtgaaatcgaacgcgaggttctgaagtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgtccgccgatcatcttcgctaacattggtacgacgatgaccgaaggcattgacaacgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagcgtattgctactagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgagccgtaatccatgtgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagaagctgcggcaccgagcgatacggccaag

SEQ ID NO: 646 - protein, 389 aa, Artificial Sequence
  Variant of Leucine Decarboxylase from Planctomycetaceae bacterium
MGNLKFPDGALSPTDQRRLEDVYQYVREQCDTFIGYPCNMHFDYTPLFPFLAYPVNNVGDPFASSSYRIHTREIEREVLKWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKPYVERIATSIEYIGTLDTTISGSRNGITPLFLWYAVKQAGRDGFKRRVAACLDNARYTVEQFKRIGVEASRNPCAITVVFPKPPQSVLEKWQIATEGDDAHICLMPSTTRQHVDELIADIAAANKEAAAPSDTAK

SEQ ID NO: 647 - DNA, 1167 bp, Artificial Sequence
  Variant of Leucine Decarboxylase from Planctomycetaceae bacterium
atgggtaatctgaaatttccagatggcgcgttgagcccgaccgaccaacgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctagctccagttatcgcatccatacccgtgaaatcgaacgcgaggttctgaagtggttcgccgaactcatgcacattgcaccagaagaatactggggttatgtgactaatggaggatcggagggcaacctgtacggtttgtttttagcgcgtgaacgctttcctacgggcgtcgcctactattcggaaacgtcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgactgaaggcattgacaacgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagcgtattgctactagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgagccgtaatccatgtgccattaccgttgtgttcccgaaacctccgcagtcagtgctggaaaagtggcaaatcgcaaccgagggcgacgatgcgcatatttgcttaatgccaagtaccacccgtcagatggtcgatgaattgatcgctgacattgcggccgccaataaagaagctgcggcaccgagcgatacggccaag

SEQ ID NO: 648 - protein, 389 aa, Artificial Sequence
  Variant of Leucine Decarboxylase from Planctomycetaceae bacterium
MGNLKFPDGALSPTDQRRLEDVYQYVREQCDTFIGYPCNMHFDYTPLFPFLAYPVNNVGDPFASSSYRIHTREIEREVLKWFAELMHIAPEEYWGYVTNGGSEGNLYGLFLARERFPTGVAYYSETSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKPYVERIATSIEYIGTLDTTISGSRNGITPLFLWYAVKQAGRDGFKRRVAACLDNARYTVEQFKRIGVEASRNPCAITVVFPKPPQSVLEKWQIATEGDDAHICLMPSTTRQMVDELIADIAAANKEAAAPSDTAK

SEQ ID NO: 649 - DNA, 1167 bp, Artificial Sequence
  Variant of Leucine Decarboxylase from Planctomycetaceae bacterium
atgggtaatctgaaatttccagatggcgcgttgagcccgaccgaccaacgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctagctccagttatcgcatccatacccgtgaaatcgaacgcgaggttctggcatggttcgccgaactcatgcacattgcaccagaagaatactggggttatgtgactaatggaggatcggagggcaacctgtacggtttgtttttagcgcgtgaacgctttcctacgggcgtcgcctactattcggaaacgtcgcattatagcgtgtataagaatctgcgtctgctgaacatgcgtcacatcatgatcaaatcacagccgaatggtgagattgattacggcgatctctacgaaactatgcgcgctcatcgtgataagccgccgatcatcttcgctaacattggtacgacgatgaccgaaggcattgacaacgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagcgtattgctactagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgcgccattaccgttgtgttcccgaaacctccgcagtcagtgctggaaaagtggcaaatcgcaaccgagggcgacgatgcgcatatttgcttaatgccaagtaccacccgtcagatggtcgatgaattgatcgctgacattgcggccgccaataaagaagctgcggcaccgagcgatacggccaag

SEQ ID NO: 650 - protein, 389 aa, Artificial Sequence
  Variant of Leucine Decarboxylase from Planctomycetaceae bacterium
MGNLKFPDGALSPTDQRRLEDVYQYVREQCDTFIGYPCNMHFDYTPLFPFLAYPVNNVGDPFASSSYRIHTREIEREVLAWFAELMHIAPEEYWGYVTNGGSEGNLYGLFLARERFPTGVAYYSETSHYSVYKNLRLLNMRHIMIKSQPNGEIDYGDLYETMRAHRDKPPIIFANIGTTMTEGIDNVRTIQDMFKKLAIHESHIHCDAALAGMTLPFMDDAPAFDFATGIDSLSISGHKFIGSPMPCGIVLTRKPYVERIATSIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTRQMVDELIADIAAANKEAAAPSDTAK

SEQ ID NO: 651 - DNA, 1167 bp, Artificial Sequence
  Variant of Leucine Decarboxylase from Planctomycetaceae bacterium
atgggtaatctgaaatttccagatggcgcgttgagcccgaccgaccaacgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctagctccagttatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgataagccgccgatcatcttcgctaacattggtacgacgatgaccgaaggcattgacaacgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagcgtattgctactagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgtgccattaccgttgtgttcccgaaacctccgcagtcagtgctggaaaagtggcaaatcgcaaccgagggcgacgatgcgcatatttgcttaatgccaagtaccacccgtcagatggtcgatgaattgatcgctgacattgcggccgccaataaagaagctgcggcaccgagcgatacggccaag

SEQ ID NO: 652 - protein, 389 aa, Artificial Sequence
  Variant of Leucine Decarboxylase from Planctomycetaceae bacterium
MGNLKFPDGALSPTDQRRLEDVYQYVREQCDTFIGYPCNMHFDYTPLFPFLAYPVNNVGDPFASSSYRIHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDKPPIIFANIGTTMTEGIDNVRTIQDMFKKLAIHESHIHCDAALAGMTLPFMDDAPAFDFATGIDSLSISGHKFIGSPMPCGIVLTRKPYVERIATSIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTRQMVDELIADIAAANKEAAAPSDTAK

SEQ ID NO: 653 - DNA, 1167 bp, Artificial Sequence
  Variant of Leucine Decarboxylase from Planctomycetaceae bacterium
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctagctccagttatcgcatccatacccgtgaaatcgaacgcgaggttctgaagtggttcgccgaactcatgcacattgcaccagaagaatactggggttatgtgactaatggaggatcggagggcaacctgtacggtttgtttttagcgcgtgaacgctttcctacgggcgtcgcctactattcggaaacgtcgcattatagcgtgtataagaatctgcgtctgctgaacatgcgtcacatcatgatcaaatcacagccgaatggtgagattgattacggcgatctctacgaaactatgcgcgctcatcgtgataagccgccgatcatcttcgctaacattggtacgacgatgaccgaaggcattgacaacgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagcgcattgctacttcgattgaatatatcggtacccgtgacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgtgccattaccgttgtgttcccgaaacctccgcagtcagtgctggaaaagtggcaaatcgcaaccgagggcgacgatgcgcatatttgcttaatgccaagtaccacccgtcagatggtcgatgaattgatcgctgacattgcggccgccaataaagaagctgcggcaccgagcgatacggccaag

SEQ ID NO: 654 - protein, 389 aa, Artificial Sequence
  Variant of Leucine Decarboxylase from Planctomycetaceae bacterium
MGNLKFPDGALSPTDRRRLEDVYQYVREQCDTFIGYPCNMHFDYTPLFPFLAYPVNNVGDPFASSSYRIHTREIEREVLKWFAELMHIAPEEYWGYVTNGGSEGNLYGLFLARERFPTGVAYYSETSHYSVYKNLRLLNMRHIMIKSQPNGEIDYGDLYETMRAHRDKPPIIFANIGTTMTEGIDNVRTIQDMFKKLAIHESHIHCDAALAGMTLPFMDDAPAFDFATGIDSLSISGHKFIGSPMPCGIVLTRKPYVERIATSIEYIGTRDTTISGSRNGITPLFLWYAVKQAGRDGFKRRVAACLDNARYTVEQFKRIGVEAMRNPCAITVVFPKPPQSVLEKWQIATEGDDAHICLMPSTTRQMVDELIADIAAANKEAAAPSDTAK

SEQ ID NO: 655 - DNA, 1167 bp, Artificial Sequence
  Variant of Leucine Decarboxylase from Planctomycetaceae bacterium
atgggtaatctgaaatttccagatggcgcgttgagcccgaccgaccaacgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgcaagctccagttatcgcatccatacccgtgaaatcgaacgcgaggttctggcatggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgataagccgccgatcatcttcgctaacattggtacgacgatgaccgaaggcattgacaacgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagcgtattgctactagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgagccgtaatccaaatgccattaccgttgtgttcccgaaacctccgcagtcagtgctggaaaagtggcaaatcgcaaccgagggcgacgatgcgcatatttgcttaatgccaagtaccacccgtcagatggtcgatgaattgatcgctgacattgcggccgccaataaagaagctgcggcaccgagcgatacggccaag

SEQ ID NO: 656 - protein, 389 aa, Artificial Sequence
  Variant of Leucine Decarboxylase from Planctomycetaceae bacterium
MGNLKFPDGALSPTDQRRLEDVYQYVREQCDTFIGYPCNMHFDYTPLFPFLAYPVNNVGDPFASSSYRIHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDKPPIIFANIGTTMTEGIDNVRTIQDMFKKLAIHESHIHCDAALAGMTLPFMDDAPAFDFATGIDSLSISGHKFIGSPMPCGIVLTRKPYVERIATSIEYIGTLDTTISGSRNGITPLFLWYAVKQAGRDGFKRRVAACLDNARYTVEQFKRIGVEASRNPNAITVVFPKPPQSVLEKWQIATEGDDAHICLMPSTTRQMVDELIADIAAANKEAAAPSDTAK

SEQ ID NO: 657 - DNA, 1167 bp, Artificial Sequence
  Variant of Leucine Decarboxylase from Planctomycetaceae bacterium
atgggtaatctgaaatttccagatggcgcgttgagcccgaccgaccaacgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctagctccagttatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgataagccgccgatcatcttcgctaacattggtacgacgatgaccgaaggcattgacaacgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagcgtattgctactagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgagccgtaatccatgtgccattaccgttgtgttcccgaaacctccgcagtcagtgctggaaaagtggcaaatcgcaaccgagggcgacgatgcgcatatttgcttaatgccaagtaccacccgtcagatggtcgatgaattgatcgctgacattgcggccgccaataaagaagctgcggcaccgagcgatacggccaag

SEQ ID NO: 658 - protein, 389 aa, Artificial Sequence
  Variant of Leucine Decarboxylase from Planctomycetaceae bacterium
MGNLKFPDGALSPTDQRRLEDVYQYVREQCDTFIGYPCNMHFDYTPLFPFLAYPVNNVGDPFASSSYRIHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDKPPIIFANIGTTMTEGIDNVRTIQDMFKKLAIHESHIHCDAALAGMTLPFMDDAPAFDFATGIDSLSISGHKFIGSPMPCGIVLTRKPYVERIATSIEYIGTLDTTISGSRNGITPLFLWYAVKQAGRDGFKRRVAACLDNARYTVEQFKRIGVEASRNPCAITVVFPKPPQSVLEKWQIATEGDDAHICLMPSTTRQMVDELIADIAAANKEAAAPSDTAK

SEQ ID NO: 659 - DNA, 1167 bp, Artificial Sequence
  Variant of Leucine Decarboxylase from Planctomycetaceae bacterium
atgggtaatctgaaatttccagatggcgcgttgagcccgaccgaccaacgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctagctccagttatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctactacgattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccaaatgccattaccgttgtgttcccgaaacctccgcagtcagtgctggaaaagtggcaaatcgcaaccgagggcgacgatgcgcatatttgcttaatgccaagtaccacccgtcagcacgtcgatgaattgatcgctgacattgcggccgccaataaagaagctgcggcaccgagcgatacggccaag

SEQ ID NO: 660 - protein, 389 aa, Artificial Sequence
  Variant of Leucine Decarboxylase from Planctomycetaceae bacterium
MGNLKFPDGALSPTDQRRLEDVYQYVREQCDTFIGYPCNMHFDYTPLFPFLAYPVNNVGDPFASSSYRIHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKPYVEKIATTIEYIGTLDTTISGSRNGITPLFLWYAVKQAGRDGFKRRVAACLDNARYTVEQFKRIGVEAMRNPNAITVVFPKPPQSVLEKWQIATEGDDAHICLMPSTTRQHVDELIADIAAANKEAAAPSDTAK

SEQ ID NO: 661 - DNA, 1167 bp, Artificial Sequence
  Variant of Leucine Decarboxylase from Planctomycetaceae bacterium
atgggtaatctgaaatttccagatggcgcgttgagcccgaccgaccaacgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgcaagctccagttatcgcatccatacccgtgaaatcgaacgcgaggttctgaagtggttcgccgaactcatgcacattgcaccagaagaatactggggttatgtgactaatggaggatcggagggcaacctgtacggtttgtttttagcgcgtgaacgctttcctacgggcgtcgcctactattcggaaacgtcgcattatagcgtgtataagaatctgcgtctgctgaacatgcgtcacatcatgatcaaatcacagccgaatggtgagattgattacggcgatctctacgaaactatgcgcgctcatcgtgattgtccgccgatcatcttcgctaacattggtacgacgatgactgaaggcattgacaacgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagcgtattgctactagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgcgccattaccgttgtgttcccgaaacctccgcagtcagtgctggaaaagtggcaaatcgcaaccgagggcgacgatgcgcatatttgcttaatgccaagtaccacccgtcagatggtcgatgaattgatcgctgacattgcggccgccaataaagaagctgcggcaccgagcgatacggccaag

SEQ ID NO: 662 - protein, 389 aa, Artificial Sequence
  Variant of Leucine Decarboxylase from Planctomycetaceae bacterium
MGNLKFPDGALSPTDQRRLEDVYQYVREQCDTFIGYPCNMHFDYTPLFPFLAYPVNNVGDPFASSSYRIHTREIEREVLKWFAELMHIAPEEYWGYVTNGGSEGNLYGLFLARERFPTGVAYYSETSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKPYVERIATSIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTRQMVDELIADIAAANKEAAAPSDTAK

SEQ ID NO: 663 - DNA, 1167 bp, Artificial Sequence
  Variant of Leucine Decarboxylase from Planctomycetaceae bacterium
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctagctccagttatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgataagccgccgatcatcttcgctaacattggtacgacgatgaccgaaggcattgacaacgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagcgtattgctactagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgtgccattaccgttgtgttcccgaaacctccgcagtcagtgctggaaaagtggcaaatcgcaaccgagggcgacgatgcgcatatttgcttaatgccaagtaccacccgtcagatggtcgatgaattgatcgctgacattgcggccgccaataaagaagctgcggcaccgagcgatacggccaag

SEQ ID NO: 664 - protein, 389 aa, Artificial Sequence
  Variant of Leucine Decarboxylase from Planctomycetaceae bacterium
MGNLKFPDGALSPTDRRRLEDVYQYVREQCDTFIGYPCNMHFDYTPLFPFLAYPVNNVGDPFASSSYRIHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDKPPIIFANIGTTMTEGIDNVRTIQDMFKKLAIHESHIHCDAALAGMTLPFMDDAPAFDFATGIDSLSISGHKFIGSPMPCGIVLTRKPYVERIATSIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTRQMVDELIADIAAANKEAAAPSDTAK

SEQ ID NO: 665 - DNA, 1167 bp, Artificial Sequence
  Variant of Leucine Decarboxylase from Planctomycetaceae bacterium
atgggtaatctgaaatttccagatggcgcgttgagcccgaccgaccaacgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctagctccagttatcgcatccatacccgtgaaatcgaacgcgaggttctgaagtggttcgccgaactcatgcacattgcaccagaagaatactggggttatgtgactaatggaggatcggagggcaacctgtacggtttgtttttagcgcgtgaacgctttcctacgggcgtcgcctactattcggaagattcgcattatagcgtgtataagaatctgcgtctgctgaacatgcgtcacatcatgatcaaatcacagccgaatggtgagattgattacggcgatctctacgaaactatgcgcgctcatcgtgataagccgccgatcatcttcgctaacattggtacgacgatgaccgaaggcattgacaacgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagcgtattgctactagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgtgccattaccgttgtgttcccgaaacctccgcagtcagtgctggaaaagtggcaaatcgcaaccgagggcgacgatgcgcatatttgcttaatgccaagtaccacccgtcagcacgtcgatgaattgatcgctgacattgcggccgccaataaagaagctgcggcaccgagcgatacggccaag

SEQ ID NO: 666 - protein, 389 aa, Artificial Sequence
  Variant of Leucine Decarboxylase from Planctomycetaceae bacterium
MGNLKFPDGALSPTDQRRLEDVYQYVREQCDTFIGYPCNMHFDYTPLFPFLAYPVNNVGDPFASSSYRIHTREIEREVLKWFAELMHIAPEEYWGYVTNGGSEGNLYGLFLARERFPTGVAYYSEDSHYSVYKNLRLLNMRHIMIKSQPNGEIDYGDLYETMRAHRDKPPIIFANIGTTMTEGIDNVRTIQDMFKKLAIHESHIHCDAALAGMTLPFMDDAPAFDFATGIDSLSISGHKFIGSPMPCGIVLTRKPYVERIATSIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTRQHVDELIADIAAANKEAAAPSDTAK

SEQ ID NO: 667 - DNA, 1167 bp, Artificial Sequence
  Variant of Leucine Decarboxylase from Planctomycetaceae bacterium
atgggtaatctgaaatttccagacggcgcgttgagcccgaccgaccaacgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgcaagctccagttatcgcatccatacccgtgaaatcgaacgcgaggttctgaagtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgataagccgccgatcatcttcgctaacattggtacgacgatgaccgaaggcattgacaacgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagcgtattgctactagtattgaatatatcggtacccgtgacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgtgccattaccgttgtgttcccgaaacctccgcagtcagtgctggaaaagtggcaaatcgcaaccgagggcgacgatgcgcatatttgcttaatgccaagtaccacccgtcagatggtcgatgaattgatcgctgacattgcggccgccaataaagaagctgcggcaccgagcgatacggccaag

SEQ ID NO: 668 - protein, 389 aa, Artificial Sequence
  Variant of Leucine Decarboxylase from Planctomycetaceae bacterium
MGNLKFPDGALSPTDQRRLEDVYQYVREQCDTFIGYPCNMHFDYTPLFPFLAYPVNNVGDPFASSSYRIHTREIEREVLKWFAELMHIAPEEYWGYVTNGGSEGNLYGLFLARERFPTGVAYYSEDSHYSVYKNLRLLNMRHIMIKSQPNGEIDYGDLYETMRAHRDKPPIIFANIGTTMTEGIDNVRTIQDMFKKLAIHESHIHCDAALAGMTLPFMDDAPAFDFATGIDSLSISGHKFIGSPMPCGIVLTRKPYVERIATSIEYIGTRDTTISGSRNGITPLFLWYAVKQAGRDGFKRRVAACLDNARYTVEQFKRIGVEAMRNPCAITVVFPKPPQSVLEKWQIATEGDDAHICLMPSTTRQMVDELIADIAAANKEAAAPSDTAK

SEQ ID NO: 669 - DNA, 1167 bp, Artificial Sequence
  Variant of Leucine Decarboxylase from Planctomycetaceae bacterium
atgggtaatctgaaatttccagatggcgcgttgagcccgaccgaccaacgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgttttgtagctccagttatcgcatccatacccgtgaaatcgaacgcgaggttctgaagtggttcgccgaactcatgcacattgcaccagaagaatactggggttatgtgactaatggaggatcggagggcaacctgtacggtttgtttttagcgcgtgaacgctttcctacgggcgtcgcctactattcggaaacgtcgcattatagcgtgtataagaatctgcgtctgctgaacatgcgtcacatcatgatcaaatcacagccgaatggtgagattgattacggcgatctctacgaaactatgcgcgctcatcgtgataagccgccgatcatcttcgctaacattggtacgacgatgaccgaaggcattgacaacgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagcgtattgctactagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgtgccattaccgttgtgttcccgaaacctccgcagtcagtgctggaaaagtggcaaatcgcaaccgagggcgacgatgcgcatatttgcttaatgccaagtaccacccgtcagatggtcgatgaattgatcgctgacattgcggccgccaataaagaagctgcggcaccgagcgatacggccaag

SEQ ID NO: 670 - protein, 389 aa, Artificial Sequence
  Variant of Leucine Decarboxylase from Planctomycetaceae bacterium
MGNLKFPDGALSPTDQRRLEDVYQYVREQCDTFIGYPCNMHFDYTPLFPFLAYPVNNVGDPFCSSSYRIHTREIEREVLKWFAELMHIAPEEYWGYVTNGGSEGNLYGLFLARERFPTGVAYYSETSHYSVYKNLRLLNMRHIMIKSQPNGEIDYGDLYETMRAHRDKPPIIFANIGTTMTEGIDNVRTIQDMFKKLAIHESHIHCDAALAGMTLPFMDDAPAFDFATGIDSLSISGHKFIGSPMPCGIVLTRKPYVERIATSIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTRQMVDELIADIAAANKEAAAPSDTAK

SEQ ID NO: 671 - DNA, 1167 bp, Artificial Sequence
  Variant of Leucine Decarboxylase from Planctomycetaceae bacterium
atgggtaatctgaaatttccagatggcgcgttgagcccgaccgaccaacgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgcaagctccagttatcgcatccatacccgtgaaatcgaacgcgaggttctggcatggttcgccgaactcatgcacattgcaccagcggaatactggggttatgtgactaatggaggatcggagggcaacctgtacggtttgtttttagcgcgtgaacgctttcctacgggcgtcgcctactattcggaaacgtcgcattatagcgtgtataagaatctgcgtctgctgaacatgcgtcacatcatgatcaaatcacagccgaatggtgagattgattacggcgatctctacgaaactatgcgcgctcatcgtgataagccgccgatcatcttcgctaacattggtacgacgatgaccgaaggcattgacaacgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagcgtattgctactagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgagccgtaatccatgtgccattaccgttgtgttcccgaaacctccgcagtcagtgctggaaaagtggcaaatcgcaaccgagggcgacgatgcgcatatttgcttaatgccaagtaccacccgtcagatggtcgatgaattgatcgctgacattgcggccgccaataaagaagctgcggcaccgagcgatacggccaag

SEQ ID NO: 672 - protein, 389 aa, Artificial Sequence
  Variant of Leucine Decarboxylase from Planctomycetaceae bacterium
MGNLKFPDGALSPTDQRRLEDVYQYVREQCDTFIGYPCNMHFDYTPLFPFLAYPVNNVGDPFASSSYRIHTREIEREVLAWFAELMHIAPAEYWGYVTNGGSEGNLYGLFLARERFPTGVAYYSETSHYSVYKNLRLLNMRHIMIKSQPNGEIDYGDLYETMRAHRDKPPIIFANIGTTMTEGIDNVRTIQDMFKKLAIHESHIHCDAALAGMTLPFMDDAPAFDFATGIDSLSISGHKFIGSPMPCGIVLTRKPYVERIATSIEYIGTLDTTISGSRNGITPLFLWYAVKQAGRDGFKRRVAACLDNARYTVEQFKRIGVEASRNPCAITVVFPKPPQSVLEKWQIATEGDDAHICLMPSTTRQMVDELIADIAAANKEAAAPSDTAK

SEQ ID NO: 673 - DNA, 1167 bp, Artificial Sequence
  Variant of Leucine Decarboxylase from Planctomycetaceae bacterium
atgggtaatctgaaatttccagatggcgcgttgagcccgaccgaccaacgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgttttgtagctccagttatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaaacgtcgcattatagcgtgtataagaatctgcgtctgctgaacatgcgtcacatcatgatcaaatcacagccgaatggtgagattgattacggcgatctctacgaaactatgcgcgctcatcgtgataagccgccgatcatcttcgctaacattggtacgacgatgaccgaaggcattgacaacgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagcgcattgctacttcgattgaatatatcggtacccgtgacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccaaatgccattaccgttgtgttcccgaaacctccgcagtcagtgctggaaaagtggcaaatcgcaaccgagggcgacgatgcgcatatttgcttaatgccaagtaccacccgtcagatggtcgatgaattgatcgctgacattgcggccgccaataaagaagctgcggcaccgagcgatacggccaag

SEQ ID NO: 674 - protein, 389 aa, Artificial Sequence
  Variant of Leucine Decarboxylase from Planctomycetaceae bacterium
MGNLKFPDGALSPTDQRRLEDVYQYVREQCDTFIGYPCNMHFDYTPLFPFLAYPVNNVGDPFCSSSYRIHTREIEREVLAWFAELMHIAPEEYWGYVTNGGSEGNLYGLFLARERFPTGVAYYSETSHYSVYKNLRLLNMRHIMIKSQPNGEIDYGDLYETMRAHRDKPPIIFANIGTTMTEGIDNVRTIQDMFKKLAIHESHIHCDAALAGMTLPFMDDAPAFDFATGIDSLSISGHKFIGSPMPCGIVLTRKPYVERIATSIEYIGTRDTTISGSRNGITPLFLWYAVKQAGRDGFKRRVAACLDNARYTVEQFKRIGVEAMRNPNAITVVFPKPPQSVLEKWQIATEGDDAHICLMPSTTRQMVDELIADIAAANKEAAAPSDTAK

SEQ ID NO: 675 - DNA, 1167 bp, Artificial Sequence
  Variant of Leucine Decarboxylase from Planctomycetaceae bacterium
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctagctccagttatcgcatccatacccgtgaaatcgaacgcgaggttctgaagtggttcgccgaactcatgcacattgcaccagaagaatactggggttatgtgactaatggaggatcggagggcaacctgtacggtttgtttttagcgcgtgaacgctttcctacgggcgtcgcctactattcggaaacgtcgcattatagcgtgtataagaatctgcgtctgctgaacatgcgtcacatcatgatcaaatcacagccgaatggtgagattgattacggcgatctctacgaaactatgcgcgctcatcgtgataagccgccgatcatcttcgctaacattggtacgacgatgaccgaaggcattgacaacgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagcgtattgctactagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgtgccattaccgttgtgttcccgaaacctccgcagtcagtgctggaaaagtggcaaatcgcaaccgagggcgacgatgcgcatatttgcttaatgccaagtaccacccgtcagatggtcgatgaattgatcgctgacattgcggccgccaataaagaagctgcggcaccgagcgatacggccaag

SEQ ID NO: 676 - protein, 389 aa, Artificial Sequence
  Variant of Leucine Decarboxylase from Planctomycetaceae bacterium
MGNLKFPDGALSPTDRRRLEDVYQYVREQCDTFIGYPCNMHFDYTPLFPFLAYPVNNVGDPFASSSYRIHTREIEREVLKWFAELMHIAPEEYWGYVTNGGSEGNLYGLFLARERFPTGVAYYSETSHYSVYKNLRLLNMRHIMIKSQPNGEIDYGDLYETMRAHRDKPPIIFANIGTTMTEGIDNVRTIQDMFKKLAIHESHIHCDAALAGMTLPFMDDAPAFDFATGIDSLSISGHKFIGSPMPCGIVLTRKPYVERIATSIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTRQMVDELIADIAAANKEAAAPSDTAK

SEQ ID NO: 677 - DNA, 1167 bp, Artificial Sequence
  Variant of Leucine Decarboxylase from Planctomycetaceae bacterium
atgggtaatctgaaatttccagatggcgcgttgagcccgaccgaccaacgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgcaagctccagttatcgcatccatacccgtgaaatcgaacgcgaggttctgaagtggttcgccgaactcatgcacattgcaccagaggaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgataagccgccgatcatcttcgctaacattggtacgacgatgaccgaaggcattgacaacgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagcgtattgctactagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgtgccattaccgttgtgttcccgaaacctccgcagtcagtgctggaaaagtggcaaatcgcaaccgagggcgacgatgcgcatatttgcttaatgccaagtaccacccgtcagatggtcgatgaattgatcgctgacattgcggccgccaataaagaagctgcggcaccgagcgatacggccaag

SEQ ID NO: 678 - protein, 389 aa, Artificial Sequence
  Variant of Leucine Decarboxylase from Planctomycetaceae bacterium
MGNLKFPDGALSPTDQRRLEDVYQYVREQCDTFIGYPCNMHFDYTPLFPFLAYPVNNVGDPFASSSYRIHTREIEREVLKWFAELMHIAPEEYWGYVTNGGSEGNLYGLFLARERFPTGVAYYSEDSHYSVYKNLRLLNMRHIMIKSQPNGEIDYGDLYETMRAHRDKPPIIFANIGTTMTEGIDNVRTIQDMFKKLAIHESHIHCDAALAGMTLPFMDDAPAFDFATGIDSLSISGHKFIGSPMPCGIVLTRKPYVERIATSIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTRQMVDELIADIAAANKEAAAPSDTAK

SEQ ID NO: 679 - DNA, 1167 bp, Artificial Sequence
  Variant of Leucine Decarboxylase from Planctomycetaceae bacterium
atgggtaatctgaaatttccagatggcgcgttgagcccgaccgaccaacgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgcaagctccagttatcgcatccatacccgtgaaatcgaacgcgaggttctgaagtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgataagccgccgatcatcttcgctaacattggtacgacgatgaccgaaggcattgacaacgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagcgtattgctactagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgagccgtaatccatgtgccattaccgttgtgttcccgaaacctccgcagtcagtgctggaaaagtggcaaatcgcaaccgagggcgacgatgcgcatatttgcttaatgccaagtaccacccgtcagcacgtcgatgaattgatcgctgacattgcggccgccaataaagaagctgcggcaccgagcgatacggccaag

SEQ ID NO: 680 - protein, 389 aa, Artificial Sequence
  Variant of Leucine Decarboxylase from Planctomycetaceae bacterium
MGNLKFPDGALSPTDQRRLEDVYQYVREQCDTFIGYPCNMHFDYTPLFPFLAYPVNNVGDPFASSSYRIHTREIEREVLKWFAELMHIAPEEYWGYVTNGGSEGNLYGLFLARERFPTGVAYYSEDSHYSVYKNLRLLNMRHIMIKSQPNGEIDYGDLYETMRAHRDKPPIIFANIGTTMTEGIDNVRTIQDMFKKLAIHESHIHCDAALAGMTLPFMDDAPAFDFATGIDSLSISGHKFIGSPMPCGIVLTRKPYVERIATSIEYIGTLDTTISGSRNGITPLFLWYAVKQAGRDGFKRRVAACLDNARYTVEQFKRIGVEASRNPCAITVVFPKPPQSVLEKWQIATEGDDAHICLMPSTTRQHVDELIADIAAANKEAAAPSDTAK

SEQ ID NO: 681 - DNA, 1167 bp, Artificial Sequence
  Variant of Leucine Decarboxylase from Planctomycetaceae bacterium
atgggtaatctgaaatttccagatggcgcgttgagcccgaccgaccaacgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctagctccagttatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagattcgcattatagcgtgtataagaatctgcgtctgctgaacatgcgtcacatcatgatcaaatcacagccgaatggtgagattgattacggcgatctctacgaaactatgcgcgctcatcgtgataagccgccgatcatcttcgctaacattggtacgacgatgaccgaaggcattgacaacgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagcgcattgctacttcgattgaatatatcggtacccgtgacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgagccgtaatccatgtgccattaccgttgtgttcccgaaacctccgcagtcagtgctggaaaagtggcaaatcgcaaccgagggcgacgatgcgcatatttgcttaatgccaagtaccacccgtcagatggtcgatgaattgatcgctgacattgcggccgccaataaagaagctgcggcaccgagcgatacggccaag

SEQ ID NO: 682 - protein, 389 aa, Artificial Sequence
  Variant of Leucine Decarboxylase from Planctomycetaceae bacterium
MGNLKFPDGALSPTDQRRLEDVYQYVREQCDTFIGYPCNMHFDYTPLFPFLAYPVNNVGDPFASSSYRIHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDKPPIIFANIGTTMTEGIDNVRTIQDMFKKLAIHESHIHCDAALAGMTLPFMDDAPAFDFATGIDSLSISGHKFIGSPMPCGIVLTRKPYVERIATSIEYIGTRDTTISGSRNGITPLFLWYAVKQAGRDGFKRRVAACLDNARYTVEQFKRIGVEASRNPCAITVVFPKPPQSVLEKWQIATEGDDAHICLMPSTTRQMVDELIADIAAANKEAAAPSDTAK

SEQ ID NO: 683 - DNA, 1167 bp, Artificial Sequence
  Variant of Leucine Decarboxylase from Planctomycetaceae bacterium
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgcaagctccagttatcgcatccatacccgtgaaatcgaacgcgaggttctgaagtggttcgccgaactcatgcacattgcaccagaggaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgataagccgccgatcatcttcgctaacattggtacgacgatgaccgaaggcattgacaacgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagcgcattgctacttcgattgaatatatcggtacccgtgacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgtgccattaccgttgtgttcccgaaacctccgcagtcagtgctggaaaagtggcaaatcgcaaccgagggcgacgatgcgcatatttgcttaatgccaagtaccacccgtcagatggtcgatgaattgatcgctgacattgcggccgccaataaagaagctgcggcaccgagcgatacggccaag

SEQ ID NO: 684 - protein, 389 aa, Artificial Sequence
  Variant of Leucine Decarboxylase from Planctomycetaceae bacterium
MGNLKFPDGALSPTDRRRLEDVYQYVREQCDTFIGYPCNMHFDYTPLFPFLAYPVNNVGDPFASSSYRIHTREIEREVLKWFAELMHIAPEEYWGYVTNGGSEGNLYGLFLARERFPTGVAYYSEDSHYSVYKNLRLLNMRHIMIKSQPNGEIDYGDLYETMRAHRDKPPIIFANIGTTMTEGIDNVRTIQDMFKKLAIHESHIHCDAALAGMTLPFMDDAPAFDFATGIDSLSISGHKFIGSPMPCGIVLTRKPYVERIATSIEYIGTRDTTISGSRNGITPLFLWYAVKQAGRDGFKRRVAACLDNARYTVEQFKRIGVEAMRNPCAITVVFPKPPQSVLEKWQIATEGDDAHICLMPSTTRQMVDELIADIAAANKEAAAPSDTAK

SEQ ID NO: 685 - DNA, 1167 bp, Artificial Sequence
  Variant of Leucine Decarboxylase from Planctomycetaceae bacterium
atgggtaatctgaaatttccagatggcgcgttgagcccgaccgaccaacgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgcaagctccagttatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagattcgcattatagcgtgtataagaatctgcgtctgctgaacatgcgtcacatcatgatcaaatcacagccgaatggtgagattgattacggcgatctctacgaaactatgcgcgctcatcgtgataagccgccgatcatcttcgctaacattggtacgacgatgaccgaaggcattgacaacgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgtgccattaccgttgtgttcccgaaacctccgcagtcagtgctggaaaagtggcaaatcgcaaccgagggcgacgatgcgcatatttgcttaatgccaagtaccacccgtcagatggtcgatgaattgatcgctgacattgcggccgccaataaagaagctgcggcaccgagcgatacggccaag

SEQ ID NO: 686 - protein, 389 aa, Artificial Sequence
  Variant of Leucine Decarboxylase from Planctomycetaceae bacterium
MGNLKFPDGALSPTDQRRLEDVYQYVREQCDTFIGYPCNMHFDYTPLFPFLAYPVNNVGDPFASSSYRIHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDKPPIIFANIGTTMTEGIDNVRTIQDMFKKLAIHESHIHCDAALAGMTLPFMDDAPAFDFATGIDSLSISGHKFIGSPMPCGIVLTRKPYVEKIATSIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTRQMVDELIADIAAANKEAAAPSDTAK

SEQ ID NO: 687 - DNA, 1167 bp, Artificial Sequence
  Variant of Leucine Decarboxylase from Planctomycetaceae bacterium
atgggtaatctgaaatttccagatggcgcgttgagcccgaccgaccaacgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgcaagctccaactatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctgatggcgtcgcctactattcggaagattcgcattatagcgtgtataagaatctgcgtctgctgaacatgcgtcacatcatgatcaaatcacagccgaatggtgagattgattacggcgatctctacgaaactatgcgcgctcatcgtgataagccgccgatcatcttcgctaacattggtacgacgatgaccgaaggcattgacaacgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatatcggtaccctggacactacgatttcgggcagccgtaatggtattacaccgctgtttctttggtacgcggtgaaacaagctggacgcgaaggcttcaaaaagcgtgttgcggcatgtctggataacgcccgctatacggtcgagcagtttaaacgcatcggtgtagaagcgatgcgtaatccatgtgccattaccgttgtgttcccgaaacctccgcagtcagtgctggaaaagtggcaaatcgcaaccgagggcgacgatgcgcatatttgcttaatgccaagtaccacccgtcagatggtcgatgaattgatcgctgacattgcggccgccaataaagaagctgcggcaccgagcgatacggccaag

SEQ ID NO: 688 - protein, 389 aa, Artificial Sequence
  Variant of Leucine Decarboxylase from Planctomycetaceae bacterium
MGNLKFPDGALSPTDQRRLEDVYQYVREQCDTFIGYPCNMHFDYTPLFPFLAYPVNNVGDPFASSNYRIHTREIEREVLAWFAELMHIAPEEYWGYVTNGGSEGNLYGLFLARERFPDGVAYYSEDSHYSVYKNLRLLNMRHIMIKSQPNGEIDYGDLYETMRAHRDKPPIIFANIGTTMTEGIDNVRTIQDMFKKLAIHESHIHCDAALAGMTLPFMDDAPAFDFATGIDSLSISGHKFIGSPMPCGIVLTRKPYVEKIATSIEYIGTLDTTISGSRNGITPLFLWYAVKQAGREGFKKRVAACLDNARYTVEQFKRIGVEAMRNPCAITVVFPKPPQSVLEKWQIATEGDDAHICLMPSTTRQMVDELIADIAAANKEAAAPSDTAK

SEQ ID NO: 689 - DNA, 1167 bp, Artificial Sequence
  Variant of Leucine Decarboxylase from Planctomycetaceae bacterium
atgggtaatctgaaatttccagatggcgcgttgagcccgaccgaccaacgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgcaagctccaactatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctgatggcgtcgcctactattcggaagattcgcattatagcgtgtataagaatctgcgtctgctgaacatgcgtcacatcatgatcaaatcacagccgaatggtgagattgattacggcgatctctacgaaactatgcgcgctcatcgtgataagccgccgatcatcttcgctaacattggtacgacgatgaccgaaggcattgacaacgtacgcaccatccaggatatgttcaagaagctggctattagtgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatatcggtaccctggacactacgatttcgggcagccgtaatggtattacaccgctgtttctttggtacgcggtgaaacaagctggacgcgaaggcttcaaacgtcgtgttcaggcatgtctggataacgcccgctatacggtcgagcaatttcagcgcatcggtgtagaagcgatgcgtaatccatgtgccattaccgttgtgttcccgaaacctccgcagtcagtgctggaaaagtggcaaatcgcaaccgagggcgacgatgcgcatatttgcttaatgccaagtaccacccgtcagatggtcgatgaattgatcgctgacattgcggccgccaataaagaagctgcggcaccgagcgatacggccaag

SEQ ID NO: 690 - protein, 389 aa, Artificial Sequence
  Variant of Leucine Decarboxylase from Planctomycetaceae bacterium
MGNLKFPDGALSPTDQRRLEDVYQYVREQCDTFIGYPCNMHFDYTPLFPFLAYPVNNVGDPFASSNYRIHTREIEREVLAWFAELMHIAPEEYWGYVTNGGSEGNLYGLFLARERFPDGVAYYSEDSHYSVYKNLRLLNMRHIMIKSQPNGEIDYGDLYETMRAHRDKPPIIFANIGTTMTEGIDNVRTIQDMFKKLAISESHIHCDAALAGMTLPFMDDAPAFDFATGIDSLSISGHKFIGSPMPCGIVLTRKPYVEKIATSIEYIGTLDTTISGSRNGITPLFLWYAVKQAGREGFKRRVQACLDNARYTVEQFQRIGVEAMRNPCAITVVFPKPPQSVLEKWQIATEGDDAHICLMPSTTRQMVDELIADIAAANKEAAAPSDTAK

SEQ ID NO: 691 - DNA, 1167 bp, Artificial Sequence
  Variant of Leucine Decarboxylase from Planctomycetaceae bacterium
atgggtaatctgaaatttccagatggcgcgttgagcccgaccgaccaacgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgcaagctccagttatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagattcgcattatagcgtgtataagaatctgcgtctgctgaacatgcctcacatcgtgatcaaatcacagccgaatggtgagattgattacggcgatctctacgaaactatgcgcgctcatcgtgataagccgccgatcatcttcgctaacattggtacgacgatgaccgaaggcattgacaacgtacgcaccatccaggatatgttcaagaagctgggtattagtgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatatcggtaccctggacactacgatttcgggcagccgtaatggtattacaccgctgtttctttggtacgcggtgaaacaagctggacgcgatggcttcaaaaagcgtgttgcggcatgtctggataacgcccgctatacggtcgagcagtttaaacgcatcggtgtagaagcgatgcgtaatccatgtgccattaccgttgtgttcccgaaacctccgcagtcagtgctggaaaagtggcaaatcgcaaccgagggcgacgatgcgcatatttgcttaatgccaagtaccacccgtcagatggtcgatgaattgatcgctgacattgcggccgccaataaagaagctgcggcaccgagcgatacggccaag

SEQ ID NO: 692 - protein, 389 aa, Artificial Sequence
  Variant of Leucine Decarboxylase from Planctomycetaceae bacterium
MGNLKFPDGALSPTDQRRLEDVYQYVREQCDTFIGYPCNMHFDYTPLFPFLAYPVNNVGDPFASSSYRIHTREIEREVLAWFAELMHIAPEEYWGYVTNGGSEGNLYGLFLARERFPTGVAYYSEDSHYSVYKNLRLLNMPHIVIKSQPNGEIDYGDLYETMRAHRDKPPIIFANIGTTMTEGIDNVRTIQDMFKKLGISESHIHCDAALAGMTLPFMDDAPAFDFATGIDSLSISGHKFIGSPMPCGIVLTRKPYVEKIATSIEYIGTLDTTISGSRNGITPLFLWYAVKQAGRDGFKKRVAACLDNARYTVEQFKRIGVEAMRNPCAITVVFPKPPQSVLEKWQIATEGDDAHICLMPSTTRQMVDELIADIAAANKEAAAPSDTAK

SEQ ID NO: 693 - DNA, 1167 bp, Artificial Sequence
  Variant of Leucine Decarboxylase from Planctomycetaceae bacterium
atgggtaatctgaaatttccagatggcgcgttgagcccgaccgaccaacgccgtctggaagatgtgtatcagtacgttcgtgagcaatgcgacaccttcatcgggtatccgtgcaacatgcactttgattacacacctctttttccgttcctggcctatccagtcaacaacgtgggcgatccgtttgcaagctccaactatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctgatggcgtcgcctactattcggaagattcgcattatagcgtgtataagaatctgcgtctgctgaacatgcgtcacatcatgatcaaatcacagccgaatggtgagattgattacggcgatctctacgaaactatgcgcgctcatcgtgataagccgccgatcatcttcgctaacattggtacgacgatgaccgaaggcattgacaacgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatatcggtaccctggacactacgatttcgggcagccgtaatggtattacaccgctgtttctttggtacgcggtgaaacaagctggacgcgaaggcttcaaacgtcgtgttgcggcatgtctggataacgcccgctatacggtcgagcagtttaaacgcatcggtgtagaagcgatgcgtaatccatgtgccattaccgttgtgttcccgaaacctccgcagtcagtgctggaaaagtggcaaatcgcaaccgagggcgacgatgcgcatatttgcttaatgccaagtaccacccgtcagatggtcgatgaattgatcgctgacattgcggccgccaataaagaagctgcggcaccgagcgatacggccaag

SEQ ID NO: 694 - protein, 389 aa, Artificial Sequence
  Variant of Leucine Decarboxylase from Planctomycetaceae bacterium
MGNLKFPDGALSPTDQRRLEDVYQYVREQCDTFIGYPCNMHFDYTPLFPFLAYPVNNVGDPFASSNYRIHTREIEREVLAWFAELMHIAPEEYWGYVTNGGSEGNLYGLFLARERFPDGVAYYSEDSHYSVYKNLRLLNMRHIMIKSQPNGEIDYGDLYETMRAHRDKPPIIFANIGTTMTEGIDNVRTIQDMFKKLAIHESHIHCDAALAGMTLPFMDDAPAFDFATGIDSLSISGHKFIGSPMPCGIVLTRKPYVEKIATSIEYIGTLDTTISGSRNGITPLFLWYAVKQAGREGFKRRVAACLDNARYTVEQFKRIGVEAMRNPCAITVVFPKPPQSVLEKWQIATEGDDAHICLMPSTTRQMVDELIADIAAANKEAAAPSDTAK

SEQ ID NO: 695 - DNA, 1167 bp, Artificial Sequence
  Variant of Leucine Decarboxylase from Planctomycetaceae bacterium
atgggtaatctgaaatttccagatggcgcgttgagcccgaccgaccaacgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgcaagctccagttatcgcatccatacccgtgaaatcgaacgcgaggttctggcgtggttcgccgaactcatgcacattccaccagaagaatactggggttatgtgactaatggaggatcggagggcaacctgtacggtttgtttttagcgcgtgaacgctttcctgatggcgtcgcctactattcggaagattcgcattatagcgtgtataagaatctgcgtctgctgaacatgcgtcacatcatgatcaaatcacagccgaatggtgagattgattacggcgatctctacgaaactatgcgcgctcatcgtgataagccgccgatcatcttcgctaacattggtacgacgatgaccgaaggcattgacaacgtacgcaccatccaggatatgttcaagaagctggctattagtgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgtgccattaccgttgtgttcccgaaacctccgcagtcagtgctggaaaagtggcaaatcgcaaccgagggcgacgatgcgcatatttgcttaatgccaagtaccacccgtcagatggtcgatgaattgatcgctgacattgcggccgccaataaagaagctgcggcaccgagcgatacggccaag

SEQ ID NO: 696 - protein, 389 aa, Artificial Sequence
  Variant of Leucine Decarboxylase from Planctomycetaceae bacterium
MGNLKFPDGALSPTDQRRLEDVYQYVREQCDTFIGYPCNMHFDYTPLFPFLAYPVNNVGDPFASSSYRIHTREIEREVLAWFAELMHIPPEEYWGYVTNGGSEGNLYGLFLARERFPDGVAYYSEDSHYSVYKNLRLLNMRHIMIKSQPNGEIDYGDLYETMRAHRDKPPIIFANIGTTMTEGIDNVRTIQDMFKKLAISESHIHCDAALAGMTLPFMDDAPAFDFATGIDSLSISGHKFIGSPMPCGIVLTRKPYVEKIATSIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTRQMVDELIADIAAANKEAAAPSDTAK

SEQ ID NO: 697 - DNA, 1167 bp, Artificial Sequence
  Variant of Leucine Decarboxylase from Planctomycetaceae bacterium
atgggtaatctgaaatttccagatggcgcgttgagcccgaccgaccaacgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgcaagctccagctatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctgatggcgtcgcctactattcggaagattcgcattatagcgtgtataagaatctgcgtctgctgaacatgcctcacatcatgatcaaatcacagccgaatggtgagattgattacggcgatctctacgaaactatgcgcgctcatcgtgataagccgccgatcatcttcgctaacattggtacgacgatgaccgaaggcattgacaacgtacgcaccatccaggatatgttcaagaagctggctattagtgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgtgccattaccgttgtgttcccgaaacctccgcagtcagtgctggaaaagtggcaaatcgcaaccgagggcgacgatgcgcatatttgcttaatgccaagtaccacccgtcagatggtcgatgaattgatcgctgacattgcggccgccaataaagaagctgcggcaccgagcgatacggccaag

SEQ ID NO: 698 - protein, 389 aa, Artificial Sequence
  Variant of Leucine Decarboxylase from Planctomycetaceae bacterium
MGNLKFPDGALSPTDQRRLEDVYQYVREQCDTFIGYPCNMHFDYTPLFPFLAYPVNNVGDPFASSSYRIHTREIEREVLAWFAELMHIAPEEYWGYVTNGGSEGNLYGLFLARERFPDGVAYYSEDSHYSVYKNLRLLNMPHIMIKSQPNGEIDYGDLYETMRAHRDKPPIIFANIGTTMTEGIDNVRTIQDMFKKLAISESHIHCDAALAGMTLPFMDDAPAFDFATGIDSLSISGHKFIGSPMPCGIVLTRKPYVEKIATSIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTRQMVDELIADIAAANKEAAAPSDTAK

SEQ ID NO: 699 - DNA, 1167 bp, Artificial Sequence
  Variant of Leucine Decarboxylase from Planctomycetaceae bacterium
atgggtaatctgaaatttccagatggcgcgttgagcccgaccgaccaacgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgcaagctccagctatcgcatccatacccgtgaaatcgaagtcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagattcgcattatagcgtgtataagaatctgcgtctgctgaacatgcctcacatcatgatcaaatcacagccgaatggtgagattgattacggcgatctctacgaaactatgcgcgctcatcgtgataagccgccgatcatcttcgctaacattggtacgacgatgaccgaaggcattgacaacgtacgcaccatccaggatatgttcaagaagctgggtattagtcgctctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatatcggtaccctggacactacgatttcgggcagccgtaatggtattacaccgctgtttctttggtacgcggtgaaacaagctggacgcgatggcttcaaaaagcgtgttgcggcatgtctggataacgcccgctatacggtcgagcagtttaaacgcatcggtgtagaagcgatgcgtaatccatgtgccattaccgttgtgttcccgaaacctccgcagtcagtgctggaaaagtggcaaatcgcaaccgagggcgacgatgcgcatatttgcttaatgccaagtaccacccgtcagatggtcgatgaattgatcgctgacattgcggccgccaataaagaagctgcggcaccgagcgatacggccaag

SEQ ID NO: 700 - protein, 389 aa, Artificial Sequence
  Variant of Leucine Decarboxylase from Planctomycetaceae bacterium
MGNLKFPDGALSPTDQRRLEDVYQYVREQCDTFIGYPCNMHFDYTPLFPFLAYPVNNVGDPFASSSYRIHTREIEVEVLAWFAELMHIAPEEYWGYVTNGGSEGNLYGLFLARERFPTGVAYYSEDSHYSVYKNLRLLNMPHIMIKSQPNGEIDYGDLYETMRAHRDKPPIIFANIGTTMTEGIDNVRTIQDMFKKLGISRSHIHCDAALAGMTLPFMDDAPAFDFATGIDSLSISGHKFIGSPMPCGIVLTRKPYVEKIATSIEYIGTLDTTISGSRNGITPLFLWYAVKQAGRDGFKKRVAACLDNARYTVEQFKRIGVEAMRNPCAITVVFPKPPQSVLEKWQIATEGDDAHICLMPSTTRQMVDELIADIAAANKEAAAPSDTAK

SEQ ID NO: 701 - DNA, 1167 bp, Artificial Sequence
  Variant of Leucine Decarboxylase from Planctomycetaceae bacterium
atgggtaatctgaaatttccagatggcgcgttgagcccgaccgaccaacgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgcaagctccaactatcgcatccatacccgtgaaatcgaagtcgaggttctggcgtggttcgccgaactcatgcacattgcaccagaagaatactggggttatgtgactaatggaggatcggagggcaacctgtacggtttgtttttagcgcgtgaacgctttcctgatggcgtcgcctactattcggaagattcgcattatagcgtgtataagaatctgcgtctgctgaacatgcctcacatcatgatcaaatcacagccgaatggtgagattgattacggcgatctctacgaaactatgcgcgctcatcgtgataagccgccgatcatcttcgctaacattggtacgacgatgaccgaaggcattgacaacgtacgcaccatccaggatatgttcaagaagctggctattcatcgctctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatatcggtaccctggacactacgatttcgggcagccgtaatggtattacaccgctgtttctttggtacgcggtgaaacaagctggacgcgatggcttcaaaaagcgtgttgcggcatgtctggataacgcccgctatacggtcgagcagtttaaacgcatcggtgtagaagcgatgcgtaatccatgtgccattaccgttgtgttcccgaaacctccgcagtcagtgctggaaaagtggcaaatcgcaaccgagggcgacgatgcgcatatttgcttaatgccaagtaccacccgtcagatggtcgatgaattgatcgctgacattgcggccgccaataaagaagctgcggcaccgagcgatacggccaag

SEQ ID NO: 702 - protein, 389 aa, Artificial Sequence
  Variant of Leucine Decarboxylase from Planctomycetaceae bacterium
MGNLKFPDGALSPTDQRRLEDVYQYVREQCDTFIGYPCNMHFDYTPLFPFLAYPVNNVGDPFASSNYRIHTREIEVEVLAWFAELMHIAPEEYWGYVTNGGSEGNLYGLFLARERFPDGVAYYSEDSHYSVYKNLRLLNMPHIMIKSQPNGEIDYGDLYETMRAHRDKPPIIFANIGTTMTEGIDNVRTIQDMFKKLAIHRSHIHCDAALAGMTLPFMDDAPAFDFATGIDSLSISGHKFIGSPMPCGIVLTRKPYVEKIATSIEYIGTLDTTISGSRNGITPLFLWYAVKQAGRDGFKKRVAACLDNARYTVEQFKRIGVEAMRNPCAITVVFPKPPQSVLEKWQIATEGDDAHICLMPSTTRQMVDELIADIAAANKEAAAPSDTAK

SEQ ID NO: 703 - DNA, 1167 bp, Artificial Sequence
  Variant of Leucine Decarboxylase from Planctomycetaceae bacterium
atgggtaatctgaaatttccagatggcgcgttgagcccgaccgaccaacgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgcaagctccagctatcgcatccatacccgtgaaatcgaagtcgaggttctggcgtggttcgccgaactcatgcacattgcaccagaagaatactggggttatgtgactaatggaggatcggagggcaacctgtacggtttgtttttagcgcgtgaacgctttcctgatggcgtcgcctactattcggaagattcgcattatagcgtgtataagaatctgcgtctgctgaacatgcctcacatcatgatcaaatcacagccgaatggtgagattgattacggcgatctctacgaaactatgcgcgctcatcgtgataagccgccgatcatcttcgctaacattggtacgacgatgaccgaaggcattgacaacgtacgcaccatccaggatatgttcaagaagctggctattagtgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatatcggtaccctggacactacgatttcgggcagccgtaatggtattacaccgctgtttctttggtacgcggtgaaacaagctggacgcgaaggcttcaaacgtcgtgttgcggcatgtctggataacgcccgctatacggtcgagcagtttaaacgcatcggtgtagaagcgatgcgtaatccatgtgccattaccgttgtgttcccgaaacctccgcagtcagtgctggaaaagtggcaaatcgcaaccgagggcgacgatgcgcatatttgcttaatgccaagtaccacccgtcagatggtcgatgaattgatcgctgacattgcggccgccaataaagaagctgcggcaccgagcgatacggccaag

SEQ ID NO: 704 - protein, 389 aa, Artificial Sequence
  Variant of Leucine Decarboxylase from Planctomycetaceae bacterium
MGNLKFPDGALSPTDQRRLEDVYQYVREQCDTFIGYPCNMHFDYTPLFPFLAYPVNNVGDPFASSSYRIHTREIEVEVLAWFAELMHIAPEEYWGYVTNGGSEGNLYGLFLARERFPDGVAYYSEDSHYSVYKNLRLLNMPHIMIKSQPNGEIDYGDLYETMRAHRDKPPIIFANIGTTMTEGIDNVRTIQDMFKKLAISESHIHCDAALAGMTLPFMDDAPAFDFATGIDSLSISGHKFIGSPMPCGIVLTRKPYVEKIATSIEYIGTLDTTISGSRNGITPLFLWYAVKQAGREGFKRRVAACLDNARYTVEQFKRIGVEAMRNPCAITVVFPKPPQSVLEKWQIATEGDDAHICLMPSTTRQMVDELIADIAAANKEAAAPSDTAK

SEQ ID NO: 705 - DNA, 1167 bp, Artificial Sequence
  Variant of Leucine Decarboxylase from Planctomycetaceae bacterium
atgggtaatctgaaatttccagatggcgcgttgagcccgaccgaccaacgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgcaagctccaactatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctaccggcgtcgcctactattcggaagattcgcattatagcgtgtataagaatctgcgtctgctgaacatgcgtcacatcatgatcaaatcacagccgaatggtgagattgattacggcgatctctacgaaactatgcgcgctcatcgtgataagccgccgatcatcttcgctaacattggtacgacgatgaccgaaggcattgacaacgtacgcaccatccaggatatgttcaagaagctggctattagtgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcaatttaagcgcatcggtgtagaagcgatgcgtaatccatgtgccattaccgttgtgttcccgaaacctccgcagtcagtgctggaaaagtggcaaatcgcaaccgagggcgacgatgcgcatatttgcttaatgccaagtaccacccgtcagatggtcgatgaattgatcgctgacattgcggccgccaataaagaagctgcggcaccgagcgatacggccaag

SEQ ID NO: 706 - protein, 389 aa, Artificial Sequence
  Variant of Leucine Decarboxylase from Planctomycetaceae bacterium
MGNLKFPDGALSPTDQRRLEDVYQYVREQCDTFIGYPCNMHFDYTPLFPFLAYPVNNVGDPFASSNYRIHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDKPPIIFANIGTTMTEGIDNVRTIQDMFKKLAISESHIHCDAALAGMTLPFMDDAPAFDFATGIDSLSISGHKFIGSPMPCGIVLTRKPYVEKIATSIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTRQMVDELIADIAAANKEAAAPSDTAK

SEQ ID NO: 707 - DNA, 1167 bp, Artificial Sequence
  Variant of Leucine Decarboxylase from Planctomycetaceae bacterium
atgggtaatctgaaatttccagatggcgcgttgagcccgaccgaccaacgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgcaagctccaactatcgcatccatacccgtgaaatcgaagtcgaggttctggcgtggttcgccgaactcatgcacattgcaccagaagaatactggggttatgtgactaatggaggatcggagggcaacctgtacggtttgtttttagcgcgtgaacgctttcctaccggcgtcgcctactattcggaagattcgcattatagcgtgtataagaatctgcgtctgctgaacatgcgtcacatcatgatcaaatcacagccgaatggtgagattgattacggcgatctctacgaaactatgcgcgctcatcgtgataagccgccgatcatcttcgctaacattggtacgacgatgaccgaaggcattgacaacgtacgcaccatccaggatatgttcaagaagctgggtattagtgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatatcggtaccctggacactacgatttcgggcagccgtaatggtattacaccgctgtttctttggtacgcggtgaaacaagctggacgcgaaggcttcaaacgtcgtgttcaggcatgtctggataacgcccgctatacggtcgagcagtttaaacgcatcggtgtagaagcgatgcgtaatccatgtgccattaccgttgtgttcccgaaacctccgcagtcagtgctggaaaagtggcaaatcgcaaccgagggcgacgatgcgcatatttgcttaatgccaagtaccacccgtcagatggtcgatgaattgatcgctgacattgcggccgccaataaagaagctgcggcaccgagcgatacggccaag

SEQ ID NO: 708 - protein, 389 aa, Artificial Sequence
  Variant of Leucine Decarboxylase from Planctomycetaceae bacterium
MGNLKFPDGALSPTDQRRLEDVYQYVREQCDTFIGYPCNMHFDYTPLFPFLAYPVNNVGDPFASSNYRIHTREIEVEVLAWFAELMHIAPEEYWGYVTNGGSEGNLYGLFLARERFPTGVAYYSEDSHYSVYKNLRLLNMRHIMIKSQPNGEIDYGDLYETMRAHRDKPPIIFANIGTTMTEGIDNVRTIQDMFKKLGISESHIHCDAALAGMTLPFMDDAPAFDFATGIDSLSISGHKFIGSPMPCGIVLTRKPYVEKIATSIEYIGTLDTTISGSRNGITPLFLWYAVKQAGREGFKRRVQACLDNARYTVEQFKRIGVEAMRNPCAITVVFPKPPQSVLEKWQIATEGDDAHICLMPSTTRQMVDELIADIAAANKEAAAPSDTAK

SEQ ID NO: 709 - DNA, 1167 bp, Artificial Sequence
  Variant of Leucine Decarboxylase from Planctomycetaceae bacterium
atgggtaatctgaaatttccagatggcgcgttgagcccgaccgaccaacgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgcaagctccaactatcgcatccatacccgtgaaatcgaagtcgaggttctggcgtggttcgccgaactcatgcacattgcaccagaagaatactggggttatgtgactaatggaggatcggagggcaacctgtacggtttgtttttagcgcgtgaacgctttcctaccggcgtcgcctactattcggaagattcgcattatagcgtgtataagaatctgcgtctgctgaacatgcgtcacatcatgatcaaatcacagccgaatggtgagattgattacggcgatctctacgaaactatgcgcgctcatcgtgataagccgccgatcatcttcgctaacattggtacgacgatgaccgaaggcattgacaacgtacgcaccatccaggatatgttcaagaagctgggtattagtgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatatcggtaccctggacactacgatttcgggcagccgtaatggtattacaccgctgtttctttggtacgcggtgaaacaagctggacgcgatggcttcaaaaagcgtgttgcggcatgtctggataacgcccgctatacggtcgagcagtttaaacgcatcggtgtagaagcgatgcgtaatccatgtgccattaccgttgtgttcccgaaacctccgcagtcagtgctggaaaagtggcaaatcgcaaccgagggcgacgatgcgcatatttgcttaatgccaagtaccacccgtcagatggtcgatgaattgatcgctgacattgcggccgccaataaagaagctgcggcaccgagcgatacggccaag

SEQ ID NO: 710 - protein, 389 aa, Artificial Sequence
  Variant of Leucine Decarboxylase from Planctomycetaceae bacterium
MGNLKFPDGALSPTDQRRLEDVYQYVREQCDTFIGYPCNMHFDYTPLFPFLAYPVNNVGDPFASSNYRIHTREIEVEVLAWFAELMHIAPEEYWGYVTNGGSEGNLYGLFLARERFPTGVAYYSEDSHYSVYKNLRLLNMRHIMIKSQPNGEIDYGDLYETMRAHRDKPPIIFANIGTTMTEGIDNVRTIQDMFKKLGISESHIHCDAALAGMTLPFMDDAPAFDFATGIDSLSISGHKFIGSPMPCGIVLTRKPYVEKIATSIEYIGTLDTTISGSRNGITPLFLWYAVKQAGRDGFKKRVAACLDNARYTVEQFKRIGVEAMRNPCAITVVFPKPPQSVLEKWQIATEGDDAHICLMPSTTRQMVDELIADIAAANKEAAAPSDTAK

SEQ ID NO: 711 - DNA, 1167 bp, Artificial Sequence
  Variant of Leucine Decarboxylase from Planctomycetaceae bacterium
atgggtaatctgaaatttccagatggcgcgttgagcccgaccgaccaacgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgcaagctccagttatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaaacttcgcattatagcgtgtataagaatctgcgtctgctgaacatgcgtcacatcatgatcaaatcacagccgaatggtgagattgattacggggatctctacgaaactatgcgcgctcatcgtgataagccgccgatcatcttcgctaacattggtacgacgatgaccgaaggcattgacaacgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttacgtggagaaaattgctacttcgattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgtgccattaccgttgtgttcccgaaacctccgcagtcagtgctggaaaagtggcaaatcgcaaccgagggcgatgatgcgcatatttgcttaatgccaagtaccacccgtcagatggtcgatgaattgatcgctgacattgcggccgccaataaagaagctgcggcaccgagcgatacggccaag

SEQ ID NO: 712 - protein, 389 aa, Artificial Sequence
  Variant of Leucine Decarboxylase from Planctomycetaceae bacterium
MGNLKFPDGALSPTDQRRLEDVYQYVREQCDTFIGYPCNMHFDYTPLFPFLAYPVNNVGDPFASSSYRIHTREIEREVLAWFAELMHIAPEEYWGYVTNGGSEGNLYGLFLARERFPTGVAYYSETSHYSVYKNLRLLNMRHIMIKSQPNGEIDYGDLYETMRAHRDKPPIIFANIGTTMTEGIDNVRTIQDMFKKLAIHESHIHCDAALAGMTLPFMDDAPAFDFATGIDSLSISGHKFIGSPMPCGIVLTRKPYVEKIATSIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTRQMVDELIADIAAANKEAAAPSDTAK

SEQ ID NO: 713 - DNA, 1167 bp, Artificial Sequence
  Variant of Leucine Decarboxylase from Planctomycetaceae bacterium
atgggtaatctgaaatttccagatggcgcgttgagcccgaccgaccaacgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgcaagctccagttatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagattcgcattatagcgtgtataagaatctgcgtctgctgaacatgcgtcacatcatgatcaaatcacagccgaatggtgagattgattacggggatctctacgaaactatgcgcgctcatcgtgataagccgccgatcatcttcgctaacattggtacgacgatgaccgaaggcattgacaacgtacgcaccatccaggatatgttcaagaagctggcgattcacgattctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatatcggtacccgtgacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgtgccattaccgttgtgttcccgaaacctccgcagtcagtgctggaaaagtggcaaatcgcaaccgagggcgctgatgcgcatatttgcttaatgccaagtaccacccgtcagatggtcgatgaattgatcgctgacattgcggccgccaataaagaagctgcggcaccgagcgatacggccaag

SEQ ID NO: 714 - protein, 389 aa, Artificial Sequence
  Variant of Leucine Decarboxylase from Planctomycetaceae bacterium
MGNLKFPDGALSPTDQRRLEDVYQYVREQCDTFIGYPCNMHFDYTPLFPFLAYPVNNVGDPFASSSYRIHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDKPPIIFANIGTTMTEGIDNVRTIQDMFKKLAIHDSHIHCDAALAGMTLPFMDDAPAFDFATGIDSLSISGHKFIGSPMPCGIVLTRKPYVEKIATSIEYIGTRDTTISGSRNGITPLFLWYAVKQAGRDGFKRRVAACLDNARYTVEQFKRIGVEAMRNPCAITVVFPKPPQSVLEKWQIATEGADAHICLMPSTTRQMVDELIADIAAANKEAAAPSDTAK

SEQ ID NO: 715 - DNA, 1167 bp, Artificial Sequence
  Variant of Leucine Decarboxylase from Planctomycetaceae bacterium
atgggtaatctgaaatttccagatggcgcgttgagcccgaccgaccaacgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgcaagctccagttatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagattcgcattatagcgtgtataagaatctgcgtctgctgaacatgcgtcacatcatgatcaaatcacagccgaatggtgagattgattacgcggatctctacgaaactatgcgcgctcatcgtgataagccgccgatcatcttcgctaacattggtacgacgatgaccgaaggcattgacaacgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttacgtggagaaaattgctacttcgattgaatatatcggtacccgtgacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgagccgtaatccatgtgccattaccgttgtgttcccgaaacctccgcagtcagtgctggaaaagtggcaaatcgcaaccgagggcgatgatgcgcatatttgcttaatgccaagtaccacccgtcagatggtcgatgaattgatcgctgacattgcggccgccaataaagaagctgcggcaccgagcgatacggccaag

SEQ ID NO: 716 - protein, 389 aa, Artificial Sequence
  Variant of Leucine Decarboxylase from Planctomycetaceae bacterium
MGNLKFPDGALSPTDQRRLEDVYQYVREQCDTFIGYPCNMHFDYTPLFPFLAYPVNNVGDPFASSSYRIHTREIEREVLAWFAELMHIAPEEYWGYVTNGGSEGNLYGLFLARERFPTGVAYYSEDSHYSVYKNLRLLNMRHIMIKSQPNGEIDYADLYETMRAHRDKPPIIFANIGTTMTEGIDNVRTIQDMFKKLAIHESHIHCDAALAGMTLPFMDDAPAFDFATGIDSLSISGHKFIGSPMPCGIVLTRKPYVEKIATSIEYIGTRDTTISGSRNGITPLFLWYAVKQAGRDGFKRRVAACLDNARYTVEQFKRIGVEASRNPCAITVVFPKPPQSVLEKWQIATEGDDAHICLMPSTTRQMVDELIADIAAANKEAAAPSDTAK

SEQ ID NO: 717 - DNA, 1167 bp, Artificial Sequence
  Variant of Leucine Decarboxylase from Planctomycetaceae bacterium
atgggtaatctgaaatttccagatggcgcgttgagcccgaccgaccaacgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgcaagctccagttatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaaacttcgcattatagcgtgtataagaatctgcgtctgctgaacatgcgtcacatcatgatcaaatcacagccgaatggtgagattgattacggggatctctacgaaactatgcgcgctcatcgtgataagccgccgatcatcttcgctaacattggtacgacgatgaccgaaggcattgacaacgtacgcaccatccaggatatgttcaagaagctggcgattcacgattctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttacgtggagaaaattgctacttcgattgaatatatcggtacccgtgacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgagccgtaatccatgtgccattaccgttgtgttcccgaaacctccgcagtcagtgctggaaaagtggcaaatcgcaaccgagggcgatgatgcgcatatttgcttaatgccaagtaccacccgtcagatggtcgatgaattgatcgctgacattgcggccgccaataaagaagctgcggcaccgagcgatacggccaag

SEQ ID NO: 718 - protein, 389 aa, Artificial Sequence
  Variant of Leucine Decarboxylase from Planctomycetaceae bacterium
MGNLKFPDGALSPTDQRRLEDVYQYVREQCDTFIGYPCNMHFDYTPLFPFLAYPVNNVGDPFASSSYRIHTREIEREVLAWFAELMHIAPEEYWGYVTNGGSEGNLYGLFLARERFPTGVAYYSETSHYSVYKNLRLLNMRHIMIKSQPNGEIDYGDLYETMRAHRDKPPIIFANIGTTMTEGIDNVRTIQDMFKKLAIHDSHIHCDAALAGMTLPFMDDAPAFDFATGIDSLSISGHKFIGSPMPCGIVLTRKPYVEKIATSIEYIGTRDTTISGSRNGITPLFLWYAVKQAGRDGFKRRVAACLDNARYTVEQFKRIGVEASRNPCAITVVFPKPPQSVLEKWQIATEGDDAHICLMPSTTRQMVDELIADIAAANKEAAAPSDTAK

SEQ ID NO: 719 - DNA, 1167 bp, Artificial Sequence
  Variant of Leucine Decarboxylase from Planctomycetaceae bacterium
atgggtaatctgaaatttccagatggcgcgttgagcccgaccgaccaacgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgcaagctccagttatcgcatccatacccgtgaaatcgaacgcgaggttctgaagtggttcgccgaactcatgcacattgcaccagaagaatactggggttatgtgactaatggaggatcggagggcaacctgtacggtttgtttttagcgcgtgaacgctttcctacgggcgtcgcctactattcggaagattcgcattatagcgtgtataagaatctgcgtctgctgaacatgcgtcacatcatgatcaaatcacagccgaatggtgagattgattacggggatctctacgaaactatgcgcgctcatcgtgataagccgccgatcatcttcgctaacattggtacgacgatgaccgaaggcattgacaacgtacgcaccatccaggatatgttcaagaagctggcgattcacgattctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatatcggtacccgtgacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgtgccattaccgttgtgttcccgaaacctccgcagtcagtgctggaaaagtggcaaatcgcaaccgagggcgacgatgcgcatatttgcttaatgccaagtaccacccgtcagatggtcgatgaattgatcgctgacattgcggccgccaataaagaagctgcggcaccgagcgatacggccaag

SEQ ID NO: 720 - protein, 389 aa, Artificial Sequence
  Variant of Leucine Decarboxylase from Planctomycetaceae bacterium
MGNLKFPDGALSPTDQRRLEDVYQYVREQCDTFIGYPCNMHFDYTPLFPFLAYPVNNVGDPFASSSYRIHTREIEREVLKWFAELMHIAPEEYWGYVTNGGSEGNLYGLFLARERFPTGVAYYSEDSHYSVYKNLRLLNMRHIMIKSQPNGEIDYGDLYETMRAHRDKPPIIFANIGTTMTEGIDNVRTIQDMFKKLAIHDSHIHCDAALAGMTLPFMDDAPAFDFATGIDSLSISGHKFIGSPMPCGIVLTRKPYVEKIATSIEYIGTRDTTISGSRNGITPLFLWYAVKQAGRDGFKRRVAACLDNARYTVEQFKRIGVEAMRNPCAITVVFPKPPQSVLEKWQIATEGDDAHICLMPSTTRQMVDELIADIAAANKEAAAPSDTAK

SEQ ID NO: 721 - DNA, 1167 bp, Artificial Sequence
  Variant of Leucine Decarboxylase from Planctomycetaceae bacterium
atgggtaatctgaaatttccagatggcgcgttgagcccgaccgaccaacgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgcaagctccagttatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagattcgcattatagcgtgtataagaatctgcgtctgctgaacatgcgtcacatcatgatcaaatcacagccgaatggtgagattgattacggcgatctctacgaaactatgcgcgctcatcgtgataagccgccgatcatcttcgctaacattggtacgacgatgaccgaaggcattgacaacgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatatcggtacccgtgacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgtgccattaccgttgtgttcccgaaacctccgcagtcagtgctggaaaagtggcaaatcgcaaccgagggcgacgatgcgcatatttgcttaatgccaagtaccacccgtcagatggtcgatgaattgatcgctgacattgcggccgccaataaagaagctgcggcaccgagcgatacggccaag

SEQ ID NO: 722 - protein, 389 aa, Artificial Sequence
  Variant of Leucine Decarboxylase from Planctomycetaceae bacterium
MGNLKFPDGALSPTDQRRLEDVYQYVREQCDTFIGYPCNMHFDYTPLFPFLAYPVNNVGDPFASSSYRIHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDKPPIIFANIGTTMTEGIDNVRTIQDMFKKLAIHESHIHCDAALAGMTLPFMDDAPAFDFATGIDSLSISGHKFIGSPMPCGIVLTRKPYVEKIATSIEYIGTRDTTISGSRNGITPLFLWYAVKQAGRDGFKRRVAACLDNARYTVEQFKRIGVEAMRNPCAITVVFPKPPQSVLEKWQIATEGDDAHICLMPSTTRQMVDELIADIAAANKEAAAPSDTAK

SEQ ID NO: 723 - DNA, 1167 bp, Artificial Sequence
  Variant of Leucine Decarboxylase from Planctomycetaceae bacterium
atgggtaatctgaaatttccagatggcgcgttgagcccgaccgaccaacgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgcaagctccagttatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaaacttcgcattatagcgtgtataagaatctgcgtctgctgaacatgcgtcacatcatgatcaaatcacagccgaatggtgagattgattacggggatctctacgaaactatgcgcgctcatcgtgataagccgccgatcatcttcgctaacattggtacgacgatgaccgaaggcattgacaacgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttacgtggagaaaattgctacttcgattgaatatatcggtacccgtgacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgtgccattaccgttgtgttcccgaaacctccgcagtcagtgctggaaaagtggcaaatcgcaaccgagggcgatgatgcgcatatttgcttaatgccaagtaccacccgtcagatggtcgatgaattgatcgctgacattgcggccgccaataaagaagctgcggcaccgagcgatacggccaag

SEQ ID NO: 724 - protein, 389 aa, Artificial Sequence
  Variant of Leucine Decarboxylase from Planctomycetaceae bacterium
MGNLKFPDGALSPTDQRRLEDVYQYVREQCDTFIGYPCNMHFDYTPLFPFLAYPVNNVGDPFASSSYRIHTREIEREVLAWFAELMHIAPEEYWGYVTNGGSEGNLYGLFLARERFPTGVAYYSETSHYSVYKNLRLLNMRHIMIKSQPNGEIDYGDLYETMRAHRDKPPIIFANIGTTMTEGIDNVRTIQDMFKKLAIHESHIHCDAALAGMTLPFMDDAPAFDFATGIDSLSISGHKFIGSPMPCGIVLTRKPYVEKIATSIEYIGTRDTTISGSRNGITPLFLWYAVKQAGRDGFKRRVAACLDNARYTVEQFKRIGVEAMRNPCAITVVFPKPPQSVLEKWQIATEGDDAHICLMPSTTRQMVDELIADIAAANKEAAAPSDTAK

SEQ ID NO: 725 - DNA, 1167 bp, Artificial Sequence
  Variant of Leucine Decarboxylase from Planctomycetaceae bacterium
atgggtaatctgaaatttccagatggcgcgttgagcccgaccgaccaacgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgcaagctccagttatcgcatccatacccgtgaaatcgaacgcgaggttctggcgtggttcgccgaactcatgcacattgcaccagaagaatactggggttatgtgactaatggaggatcggagggcaacatgtacggtttgtttttagcgcgtgaacgctttcctacgggcgtcgcctactattcggaagattcgcattatagcgtgtataagaatctgcgtctgctgaacatgcgtcacatcatgatcaaatcacagccgaatggtgagattgattacggggatctctacgaaactatgcgcgctcatcgtgataagccgccgatcatcttcgctaacattggtacgacgatgaccgaaggcattgacaacgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttacgtggagaaaattgctacttcgattgaatatatcggtacccgtgacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgagccgtaatccatgtgccattaccgttgtgttcccgaaacctccgcagtcagtgctggaaaagtggcaaatcgcaaccgagggcgctgatgcgcatatttgcttaatgccaagtaccacccgtcagatggtcgatgaattgatcgctgacattgcggccgccaataaagaagctgcggcaccgagcgatacggccaag

SEQ ID NO: 726 - protein, 389 aa, Artificial Sequence
  Variant of Leucine Decarboxylase from Planctomycetaceae bacterium
MGNLKFPDGALSPTDQRRLEDVYQYVREQCDTFIGYPCNMHFDYTPLFPFLAYPVNNVGDPFASSSYRIHTREIEREVLAWFAELMHIAPEEYWGYVTNGGSEGNMYGLFLARERFPTGVAYYSEDSHYSVYKNLRLLNMRHIMIKSQPNGEIDYGDLYETMRAHRDKPPIIFANIGTTMTEGIDNVRTIQDMFKKLAIHESHIHCDAALAGMTLPFMDDAPAFDFATGIDSLSISGHKFIGSPMPCGIVLTRKPYVEKIATSIEYIGTRDTTISGSRNGITPLFLWYAVKQAGRDGFKRRVAACLDNARYTVEQFKRIGVEASRNPCAITVVFPKPPQSVLEKWQIATEGADAHICLMPSTTRQMVDELIADIAAANKEAAAPSDTAK

SEQ ID NO: 727 - DNA, 1167 bp, Artificial Sequence
  Variant of Leucine Decarboxylase from Planctomycetaceae bacterium
atgggtaatctgaaatttccagatggcgcgttgagcccgaccgaccaacgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgcaagctccagttatcgcatccatacccgtgaaatcgaacgcgaggttctagcgtggttcgccgaactcatgcacattgcaccagaagaatactggggttatgtgactaatggaggatcggagggcaacctgtacggtttgtttttagcgcgtgaacgctttcctacgggcgtcgcctactattcggaagattcgcattatagcgtgtataagaatctgcgtctgctgaacatgcgtcacatcatgatcaaatcacagccgaatggtgagattgattacggggatctctacgaaactatgcgcgctcatcgtgataagccgccgatcatcttcgctaacattggtacgacgatgaccgaaggcattgacaacgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttacgtggagaaaattgctacttcgattgaatatatcggtacccgtgacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgagccgtaatccatgtgccattaccgttgtgttcccgaaacctccgcagtcagtgctggaaaagtggcaaatcgcaaccgagggcgatgatgcgcatatttgcttaatgccaagtaccacccgtcagatggtcgatgaattgatcgctgacattgcggccgccaataaagaagctgcggcaccgagcgatacggccaag

SEQ ID NO: 728 - protein, 389 aa, Artificial Sequence
  Variant of Leucine Decarboxylase from Planctomycetaceae bacterium
MGNLKFPDGALSPTDQRRLEDVYQYVREQCDTFIGYPCNMHFDYTPLFPFLAYPVNNVGDPFASSSYRIHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDKPPIIFANIGTTMTEGIDNVRTIQDMFKKLAIHESHIHCDAALAGMTLPFMDDAPAFDFATGIDSLSISGHKFIGSPMPCGIVLTRKPYVEKIATSIEYIGTRDTTISGSRNGITPLFLWYAVKQAGRDGFKRRVAACLDNARYTVEQFKRIGVEASRNPCAITVVFPKPPQSVLEKWQIATEGDDAHICLMPSTTRQMVDELIADIAAANKEAAAPSDTAK

SEQ ID NO: 729 - DNA, 1167 bp, Artificial Sequence
  Variant of Leucine Decarboxylase from Planctomycetaceae bacterium
atgggtaatctgaaatttccagatggcgcgttgagcccgaccgaccaacgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgcaagctccagttatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagattcgcattatagcgtgtataagaatctgcgtctgctgaacatgcgtcacatcatgatcaaatcacagccgaatggtgagattgattacgcggatctctacgaaactatgcgcgctcatcgtgataagccgccgatcatcttcgctaacattggtacgacgatgaccgaaggcattgacaacgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttacgtggagaaaattgctacttcgattgaatatatcggtacccgtgacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgtgccattaccgttgtgttcccgaaacctccgcagtcagtgctggaaaagtggcaaatcgcaaccgagggcgatgatgcgcatatttgcttaatgccaagtaccacccgtcagatggtcgatgaattgatcgctgacattgcggccgccaataaagaagctgcggcaccgagcgatacggccaag

SEQ ID NO: 730 - protein, 389 aa, Artificial Sequence
  Variant of Leucine Decarboxylase from Planctomycetaceae bacterium
MGNLKFPDGALSPTDQRRLEDVYQYVREQCDTFIGYPCNMHFDYTPLFPFLAYPVNNVGDPFASSSYRIHTREIEREVLAWFAELMHIAPEEYWGYVTNGGSEGNLYGLFLARERFPTGVAYYSEDSHYSVYKNLRLLNMRHIMIKSQPNGEIDYADLYETMRAHRDKPPIIFANIGTTMTEGIDNVRTIQDMFKKLAIHESHIHCDAALAGMTLPFMDDAPAFDFATGIDSLSISGHKFIGSPMPCGIVLTRKPYVEKIATSIEYIGTRDTTISGSRNGITPLFLWYAVKQAGRDGFKRRVAACLDNARYTVEQFKRIGVEAMRNPCAITVVFPKPPQSVLEKWQIATEGDDAHICLMPSTTRQMVDELIADIAAANKEAAAPSDTAK

SEQ ID NO: 731 - DNA, 1167 bp, Artificial Sequence
  Variant of Leucine Decarboxylase from Planctomycetaceae bacterium
atgggtaatctgaaatttccagatggcgcgttgagcccgaccgaccaacgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgcaagctccagttatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagattcgcattatagcgtgtataagaatctgcgtctgctgaacatgcgtcacatcatgatcaaatcacagccgaatggtgagattgattacggggatctctacgaaactatgcgcgctcatcgtgataagccgccgatcatcttcgctaacattggtacgacgatgaccgaaggcattgacaacgtacgcaccatccaggatatgttcaagaagctggcgattcacgattctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatatcggtacccgtgacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgtgccattaccgttgtgttcccgaaacctccgcagtcagtgctggaaaagtggcaaatcgcaaccgagggcgatgatgcgcatatttgcttaatgccaagtaccacccgtcagatggtcgatgaattgatcgctgacattgcggccgccaataaagaagctgcggcaccgagcgatacggccaag

SEQ ID NO: 732 - protein, 389 aa, Artificial Sequence
  Variant of Leucine Decarboxylase from Planctomycetaceae bacterium
MGNLKFPDGALSPTDQRRLEDVYQYVREQCDTFIGYPCNMHFDYTPLFPFLAYPVNNVGDPFASSSYRIHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDKPPIIFANIGTTMTEGIDNVRTIQDMFKKLAIHDSHIHCDAALAGMTLPFMDDAPAFDFATGIDSLSISGHKFIGSPMPCGIVLTRKPYVEKIATSIEYIGTRDTTISGSRNGITPLFLWYAVKQAGRDGFKRRVAACLDNARYTVEQFKRIGVEAMRNPCAITVVFPKPPQSVLEKWQIATEGDDAHICLMPSTTRQMVDELIADIAAANKEAAAPSDTAK

SEQ ID NO: 733 - DNA, 1167 bp, Artificial Sequence
  Variant of Leucine Decarboxylase from Planctomycetaceae bacterium
atgggtaatctgaaatttccagatggcgcgttgagcccgaccgaccaacgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgcaagctccagttatcgcatccatacccgtgaaatcgaacgcgaggttctgaagtggttcgccgaactcatgcacattgcaccagaagaatactggggttatgtgactaatggaggatcggagggcaacctgtacggtttgtttttagcgcgtgaacgctttcctacgggcgtcgcctactattcggaagattcgcattatagcgtgtataagaatctgcgtctgctgaacatgcgtcacatcatgatcaaatcacagccgaatggtgagattgattacggggatctctacgaaactatgcgcgctcatcgtgataagccgccgatcatcttcgctaacattggtacgacgatgaccgaaggcattgacaacgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttacgtggagaaaattgctacttcgattgaatatatcggtacccgtgacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgagccgtaatccatgtgccattaccgttgtgttcccgaaacctccgcagtcagtgctggaaaagtggcaaatcgcaaccgagggcgatgatgcgcatatttgcttaatgccaagtaccacccgtcagatggtcgatgaattgatcgctgacattgcggccgccaataaagaagctgcggcaccgagcgatacggccaag

SEQ ID NO: 734 - protein, 389 aa, Artificial Sequence
  Variant of Leucine Decarboxylase from Planctomycetaceae bacterium
MGNLKFPDGALSPTDQRRLEDVYQYVREQCDTFIGYPCNMHFDYTPLFPFLAYPVNNVGDPFASSSYRIHTREIEREVLKWFAELMHIAPEEYWGYVTNGGSEGNLYGLFLARERFPTGVAYYSEDSHYSVYKNLRLLNMRHIMIKSQPNGEIDYGDLYETMRAHRDKPPIIFANIGTTMTEGIDNVRTIQDMFKKLAIHESHIHCDAALAGMTLPFMDDAPAFDFATGIDSLSISGHKFIGSPMPCGIVLTRKPYVEKIATSIEYIGTRDTTISGSRNGITPLFLWYAVKQAGRDGFKRRVAACLDNARYTVEQFKRIGVEASRNPCAITVVFPKPPQSVLEKWQIATEGDDAHICLMPSTTRQMVDELIADIAAANKEAAAPSDTAK

SEQ ID NO: 735 - DNA, 1167 bp, Artificial Sequence
  Variant of Leucine Decarboxylase from Planctomycetaceae bacterium
atgggtaatctgaaatttccagatggcgcgttgagcccgaccgaccaacgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgcaagctccagttatcgcatccatacccgtgaaatcgaacgcgaggttctgaagtggttcgccgaactcatgcacattgcaccagaagaatactggggttatgtgactaatggaggatcggagggcaacctgtacggtttgtttttagcgcgtgaacgctttcctacgggcgtcgcctactattcggaagattcgcattatagcgtgtataagaatctgcgtctgctgaacatgcgtcacatcatgatcaaatcacagccgaatggtgagattgattacggggatctctacgaaactatgcgcgctcatcgtgataagccgccgatcatcttcgctaacattggtacgacgatgaccgaaggcattgacaacgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatatcggtacccgtgacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgtgccattaccgttgtgttcccgaaacctccgcagtcagtgctggaaaagtggcaaatcgcaaccgagggcgatgatgcgcatatttgcttaatgccaagtaccacccgtcagatggtcgatgaattgatcgctgacattgcggccgccaataaagaagctgcggcaccgagcgatacggccaag

SEQ ID NO: 736 - protein, 389 aa, Artificial Sequence
  Variant of Leucine Decarboxylase from Planctomycetaceae bacterium
MGNLKFPDGALSPTDQRRLEDVYQYVREQCDTFIGYPCNMHFDYTPLFPFLAYPVNNVGDPFASSSYRIHTREIEREVLKWFAELMHIAPEEYWGYVTNGGSEGNLYGLFLARERFPTGVAYYSEDSHYSVYKNLRLLNMRHIMIKSQPNGEIDYGDLYETMRAHRDKPPIIFANIGTTMTEGIDNVRTIQDMFKKLAIHESHIHCDAALAGMTLPFMDDAPAFDFATGIDSLSISGHKFIGSPMPCGIVLTRKPYVEKIATSIEYIGTRDTTISGSRNGITPLFLWYAVKQAGRDGFKRRVAACLDNARYTVEQFKRIGVEAMRNPCAITVVFPKPPQSVLEKWQIATEGDDAHICLMPSTTRQMVDELIADIAAANKEAAAPSDTAK

SEQ ID NO: 737 - DNA, 1167 bp, Artificial Sequence
  Variant of Leucine Decarboxylase from Planctomycetaceae bacterium
atgggtaatctgaaatttccagatggcgcgttgagcccgaccgaccaacgccgtattgaagatgtgtatcagtacgttcgtgagcaatgcgacaccttcatcgggtatccgtgcaacatgcactttgattacacacctctttttccgttcctggcctatcccgtcaacaacgtgggcgatccgtttgcaagctccagttatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagattcgcattatagcgtgtataagaatctgcgtctgctgaacatgcgtcacatcatgatcaaatcacagccgaatggtgagattgattacggcgatctctacgaaactatgcgcgctcatcgtgataagccgccgatcatcttcgctaacattggtacgacgatgaccgaaggcattgacaacgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgtgccattaccgttgtgttcccgaaacctccgcagtcagtgctggaaaagtggcaaatcgcaaccgagggcgacgatgcgcatatttgcttaatgccaagtaccacccgtcagatggtcgatgaattgatcgctgacattgcggccgccaataaagaagctgcggcaccgagcgatacggccaag

SEQ ID NO: 738 - protein, 389 aa, Artificial Sequence
  Variant of Leucine Decarboxylase from Planctomycetaceae bacterium
MGNLKFPDGALSPTDQRRIEDVYQYVREQCDTFIGYPCNMHFDYTPLFPFLAYPVNNVGDPFASSSYRIHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDKPPIIFANIGTTMTEGIDNVRTIQDMFKKLAIHESHIHCDAALAGMTLPFMDDAPAFDFATGIDSLSISGHKFIGSPMPCGIVLTRKPYVEKIATSIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTRQMVDELIADIAAANKEAAAPSDTAK

SEQ ID NO: 739 - DNA, 1167 bp, Artificial Sequence
  Variant of Leucine Decarboxylase from Planctomycetaceae bacterium
atgggtaatctgaaatttccagatggcgcgttgagcccgaccgaccaacgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgcaagctccagttatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagattcgcattatagcgtgtataagtctctgcgtctgctgaacatgcgtcacatcatgatcaaatcacagccgaatggtgagattgattacggcgatctctacgaaactatgcgcgctcatcgtgataagccgccgatcatcttcgctaacattggtacgacgatgaccgaaggcattgacaacgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgtgccattaccgttgtgttcccgaaacctccgcagtcagtgctggaaaagtggcaaatcgcaaccgagggcgacgatgcgcatatttgcttaatgccaagtaccacccgtcagatggtcgatgaattgatcgctgacattgcggccgccaataaagaagctgcggcaccgagcgatacggccaag

SEQ ID NO: 740 - protein, 389 aa, Artificial Sequence
  Variant of Leucine Decarboxylase from Planctomycetaceae bacterium
MGNLKFPDGALSPTDQRRLEDVYQYVREQCDTFIGYPCNMHFDYTPLFPFLAYPVNNVGDPFASSSYRIHTREIEREVLAWFAELMHIAPEEYWGYVTNGGSEGNLYGLFLARERFPTGVAYYSEDSHYSVYKSLRLLNMRHIMIKSQPNGEIDYGDLYETMRAHRDKPPIIFANIGTTMTEGIDNVRTIQDMFKKLAIHESHIHCDAALAGMTLPFMDDAPAFDFATGIDSLSISGHKFIGSPMPCGIVLTRKPYVEKIATSIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTRQMVDELIADIAAANKEAAAPSDTAK

SEQ ID NO: 741 - DNA, 1167 bp, Artificial Sequence
  Variant of Leucine Decarboxylase from Planctomycetaceae bacterium
atgggtaatctgaaatttccagatggcgcgttgagcccgaccgaccaacgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgcaagctccagttatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagattcgcattatagcgtgtataagaatctgcgtctgctgaacatgcgtcacatcatgatcaaatcacagccgaatggtgagattgattacggcgatctctacgaaactatgcgcgctcatcgtgataagccgccgatcatcactgctaacattggtacgacgatgaccgaaggcattgacaacgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgtgccattaccgttgtgttcccgaaacctccgcagtcagtgctggaaaagtggcaaatcgcaaccgagggcgacgatgcgcatatttgcttaatgccaagtaccacccgtcagatggtcgatgaattgatcgctgacattgcggccgccaataaagaagctgcggcaccgagcgatacggccaag

SEQ ID NO: 742 - protein, 389 aa, Artificial Sequence
  Variant of Leucine Decarboxylase from Planctomycetaceae bacterium
MGNLKFPDGALSPTDQRRLEDVYQYVREQCDTFIGYPCNMHFDYTPLFPFLAYPVNNVGDPFASSSYRIHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDKPPIITANIGTTMTEGIDNVRTIQDMFKKLAIHESHIHCDAALAGMTLPFMDDAPAFDFATGIDSLSISGHKFIGSPMPCGIVLTRKPYVEKIATSIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTRQMVDELIADIAAANKEAAAPSDTAK

SEQ ID NO: 743 - DNA, 1167 bp, Artificial Sequence
  Variant of Leucine Decarboxylase from Planctomycetaceae bacterium
atgggtaatctgaaatttccagatggcgcgttgagcccgaccgaccaacgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgcaagctccagttatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagattcgcattatagcgtgtataagaatctgcgtctgctgaacatgcgtcacatcatgatcaaatcacagccgaatggtgagattgattacggcgatctctacgaaactatgcgcgctcatcgtgataagccggctatcatcttcgctaacattggtacgacgatgaccgaaggcattgacaacgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgtgccattaccgttgtgttcccgaaacctccgcagtcagtgctggaaaagtggcaaatcgcaaccgagggcgacgatgcgcatatttgcttaatgccaagtaccacccgtcagatggtcgatgaattgatcgctgacattgcggccgccaataaagaagctgcggcaccgagcgatacggccaag

SEQ ID NO: 744 - protein, 389 aa, Artificial Sequence
  Variant of Leucine Decarboxylase from Planctomycetaceae bacterium
MGNLKFPDGALSPTDQRRLEDVYQYVREQCDTFIGYPCNMHFDYTPLFPFLAYPVNNVGDPFASSSYRIHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDKPAIIFANIGTTMTEGIDNVRTIQDMFKKLAIHESHIHCDAALAGMTLPFMDDAPAFDFATGIDSLSISGHKFIGSPMPCGIVLTRKPYVEKIATSIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTRQMVDELIADIAAANKEAAAPSDTAK

SEQ ID NO: 745 - DNA, 1167 bp, Artificial Sequence
  Variant of Leucine Decarboxylase from Planctomycetaceae bacterium
atgggtaatctgaaatttccagatggcgcgttgagcccgaccgaccaacgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgcaagctccagttatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctacatgtcggaagattcgcattatagcgtgtataagaatctgcgtctgctgaacatgcgtcacatcatgatcaaatcacagccgaatggtgagattgattacggcgatctctacgaaactatgcgcgctcatcgtgataagccgccgatcatcttcgctaacattggtacgacgatgaccgaaggcattgacaacgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgtgccattaccgttgtgttcccgaaacctccgcagtcagtgctggaaaagtggcaaatcgcaaccgagggcgacgatgcgcatatttgcttaatgccaagtaccacccgtcagatggtcgatgaattgatcgctgacattgcggccgccaataaagaagctgcggcaccgagcgatacggccaag

SEQ ID NO: 746 - protein, 389 aa, Artificial Sequence
  Variant of Leucine Decarboxylase from Planctomycetaceae bacterium
MGNLKFPDGALSPTDQRRLEDVYQYVREQCDTFIGYPCNMHFDYTPLFPFLAYPVNNVGDPFASSSYRIHTREIEREVLAWFAELMHIAPEEYWGYVTNGGSEGNLYGLFLARERFPTGVAYMSEDSHYSVYKNLRLLNMRHIMIKSQPNGEIDYGDLYETMRAHRDKPPIIFANIGTTMTEGIDNVRTIQDMFKKLAIHESHIHCDAALAGMTLPFMDDAPAFDFATGIDSLSISGHKFIGSPMPCGIVLTRKPYVEKIATSIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTRQMVDELIADIAAANKEAAAPSDTAK

SEQ ID NO: 747 - DNA, 1167 bp, Artificial Sequence
  Variant of Leucine Decarboxylase from Planctomycetaceae bacterium
atgggtaatctgaaatttccagatggcgcgttgagcccgaccgaccaacgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgcaagctccagttatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagattcgcattatagcgtgtataagaatctgcgtctgctgaacatgcgtcacatcatgatcaaatcacagccgaatggtgagattgattacggcgatctctacgaaactatgcgcgctcatcgtgataagccgccgatcatcttcgctaacattggtacgacgatgaccgaaggcattgacaacttgcgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgtgccattaccgttgtgttcccgaaacctccgcagtcagtgctggaaaagtggcaaatcgcaaccgagggcgacgatgcgcatatttgcttaatgccaagtaccacccgtcagatggtcgatgaattgatcgctgacattgcggccgccaataaagaagctgcggcaccgagcgatacggccaag

SEQ ID NO: 748 - protein, 389 aa, Artificial Sequence
  Variant of Leucine Decarboxylase from Planctomycetaceae bacterium
MGNLKFPDGALSPTDQRRLEDVYQYVREQCDTFIGYPCNMHFDYTPLFPFLAYPVNNVGDPFASSSYRIHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDKPPIIFANIGTTMTEGIDNLRTIQDMFKKLAIHESHIHCDAALAGMTLPFMDDAPAFDFATGIDSLSISGHKFIGSPMPCGIVLTRKPYVEKIATSIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTRQMVDELIADIAAANKEAAAPSDTAK

SEQ ID NO: 749 - DNA, 1167 bp, Artificial Sequence
  Variant of Leucine Decarboxylase from Planctomycetaceae bacterium
atgggtaatctgaaatttccagatggcgcgttgagcccgaccgaccaacgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgcaagctccagttatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagattcgcattatagcgtgtataagaatctgcgtctgctgaacatgcgtcacatcatgatcaaatcacagccgaatggtgagattgattacggcgatctctacgaaactatgcgcgctcatcgtgataagccgccgatcatcttcgctaacattggtacgacgatgaccgaaggcattgacaacgtacgcaccatccaggatatgttcaagaagctggcgattcacgaatctcatatccattgtgacgcagcattatctgggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgtgccattaccgttgtgttcccgaaacctccgcagtcagtgctggaaaagtggcaaatcgcaaccgagggcgacgatgcgcatatttgcttaatgccaagtaccacccgtcagatggtcgatgaattgatcgctgacattgcggccgccaataaagaagctgcggcaccgagcgatacggccaag

SEQ ID NO: 750 - protein, 389 aa, Artificial Sequence
  Variant of Leucine Decarboxylase from Planctomycetaceae bacterium
MGNLKFPDGALSPTDQRRLEDVYQYVREQCDTFIGYPCNMHFDYTPLFPFLAYPVNNVGDPFASSSYRIHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDKPPIIFANIGTTMTEGIDNVRTIQDMFKKLAIHESHIHCDAALSGMTLPFMDDAPAFDFATGIDSLSISGHKFIGSPMPCGIVLTRKPYVEKIATSIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTRQMVDELIADIAAANKEAAAPSDTAK

SEQ ID NO: 751 - DNA, 1167 bp, Artificial Sequence
  Variant of Leucine Decarboxylase from Planctomycetaceae bacterium
atgggtaatctgaaatttccagatggcgcgttgagcccgaccgaccaacgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgcaagctccagttatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagattcgcattatagcgtgtataagaatctgcgtctgctgaacatgcgtcacatcatgatcaaatcacagccgaatggtgagattgattacggcgatctctacgaaactatgcgcgctcatcgtgataagccgccgatcatcattgctaacattggtacgacgatgaccgaaggcattgacaacgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgtgccattaccgttgtgttcccgaaacctccgcagtcagtgctggaaaagtggcaaatcgcaaccgagggcgacgatgcgcatatttgcttaatgccaagtaccacccgtcagatggtcgatgaattgatcgctgacattgcggccgccaataaagaagctgcggcaccgagcgatacggccaag

SEQ ID NO: 752 - protein, 389 aa, Artificial Sequence
  Variant of Leucine Decarboxylase from Planctomycetaceae bacterium
MGNLKFPDGALSPTDQRRLEDVYQYVREQCDTFIGYPCNMHFDYTPLFPFLAYPVNNVGDPFASSSYRIHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDKPPIIIANIGTTMTEGIDNVRTIQDMFKKLAIHESHIHCDAALAGMTLPFMDDAPAFDFATGIDSLSISGHKFIGSPMPCGIVLTRKPYVEKIATSIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTRQMVDELIADIAAANKEAAAPSDTAK

SEQ ID NO: 753 - DNA, 1167 bp, Artificial Sequence
  Variant of Leucine Decarboxylase from Planctomycetaceae bacterium
atgggtaatctgaaatttccagatggcgcgttgagcccgaccgaccaacgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgcaagctccagttatcgcatccatacccgtgaaatcgaacgcgaggttctggcgtggttcgccgaactcatgcacattgcaccagaagaatactggggttatgtgactaatggaggatcggagggcaacctgtacggtgggtttttagcgcgtgaacgctttcctacgggcgtcgcctactattcggaagattcgcattatagcgtgtataagaatctgcgtctgctgaacatgcgtcacatcatgatcaaatcacagccgaatggtgagattgattacggcgatctctacgaaactatgcgcgctcatcgtgataagccgccgatcatcttcgctaacattggtacgacgatgaccgaaggcattgacaacgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgtgccattaccgttgtgttcccgaaacctccgcagtcagtgctggaaaagtggcaaatcgcaaccgagggcgacgatgcgcatatttgcttaatgccaagtaccacccgtcagatggtcgatgaattgatcgctgacattgcggccgccaataaagaagctgcggcaccgagcgatacggccaag

SEQ ID NO: 754 - protein, 389 aa, Artificial Sequence
  Variant of Leucine Decarboxylase from Planctomycetaceae bacterium
MGNLKFPDGALSPTDQRRLEDVYQYVREQCDTFIGYPCNMHFDYTPLFPFLAYPVNNVGDPFASSSYRIHTREIEREVLAWFAELMHIAPEEYWGYVTNGGSEGNLYGGFLARERFPTGVAYYSEDSHYSVYKNLRLLNMRHIMIKSQPNGEIDYGDLYETMRAHRDKPPIIFANIGTTMTEGIDNVRTIQDMFKKLAIHESHIHCDAALAGMTLPFMDDAPAFDFATGIDSLSISGHKFIGSPMPCGIVLTRKPYVEKIATSIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTRQMVDELIADIAAANKEAAAPSDTAK

SEQ ID NO: 755 - DNA, 1167 bp, Artificial Sequence
  Variant of Leucine Decarboxylase from Planctomycetaceae bacterium
atgggtaatctgaaatttccagatggcgcgttgagcccgaccgaccaacgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgcaagctccagttatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagattcgcattatagcgtgtataaggcgctgcgtctgctgaacatgcgtcacatcatgatcaaatcacagccgaatggtgagattgattacggcgatctctacgaaactatgcgcgctcatcgtgataagccgccgatcatcttcgctaacattggtacgacgatgaccgaaggcattgacaacgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgtgccattaccgttgtgttcccgaaacctccgcagtcagtgctggaaaagtggcaaatcgcaaccgagggcgacgatgcgcatatttgcttaatgccaagtaccacccgtcagatggtcgatgaattgatcgctgacattgcggccgccaataaagaagctgcggcaccgagcgatacggccaag

SEQ ID NO: 756 - protein, 389 aa, Artificial Sequence
  Variant of Leucine Decarboxylase from Planctomycetaceae bacterium
MGNLKFPDGALSPTDQRRLEDVYQYVREQCDTFIGYPCNMHFDYTPLFPFLAYPVNNVGDPFASSSYRIHTREIEREVLAWFAELMHIAPEEYWGYVTNGGSEGNLYGLFLARERFPTGVAYYSEDSHYSVYKALRLLNMRHIMIKSQPNGEIDYGDLYETMRAHRDKPPIIFANIGTTMTEGIDNVRTIQDMFKKLAIHESHIHCDAALAGMTLPFMDDAPAFDFATGIDSLSISGHKFIGSPMPCGIVLTRKPYVEKIATSIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTRQMVDELIADIAAANKEAAAPSDTAK

SEQ ID NO: 757 - DNA, 1167 bp, Artificial Sequence
  Variant of Leucine Decarboxylase from Planctomycetaceae bacterium
atgggtaatctgaaatttccagatggcgcgttgagcccgaccgaccaacgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgcaagctccagttatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagattcgcattatagcgtgtataagaatctgcgtctgctgaacatgcgtcacatcatgatcaaatcacagccgaatggtgagattgattacggcgatctctacgaaactatgcgcgctcatcgtgataagccgccgatcatcttcgctaacattggtacgacgatgaccgaaggcattgacaacgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatgcggtcgagcagtttaaacgcatcggtgtagaagcgatgcgtaatccatgtgccattaccgttgtgttcccgaaacctccgcagtcagtgctggaaaagtggcaaatcgcaaccgagggcgacgatgcgcatatttgcttaatgccaagtaccacccgtcagatggtcgatgaattgatcgctgacattgcggccgccaataaagaagctgcggcaccgagcgatacggccaag

SEQ ID NO: 758 - protein, 389 aa, Artificial Sequence
  Variant of Leucine Decarboxylase from Planctomycetaceae bacterium
MGNLKFPDGALSPTDQRRLEDVYQYVREQCDTFIGYPCNMHFDYTPLFPFLAYPVNNVGDPFASSSYRIHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDKPPIIFANIGTTMTEGIDNVRTIQDMFKKLAIHESHIHCDAALAGMTLPFMDDAPAFDFATGIDSLSISGHKFIGSPMPCGIVLTRKPYVEKIATSIEYIGTLDTTISGSRNGITPLFLWYAVKQAGRDGFKRRVAACLDNARYAVEQFKRIGVEAMRNPCAITVVFPKPPQSVLEKWQIATEGDDAHICLMPSTTRQMVDELIADIAAANKEAAAPSDTAK

SEQ ID NO: 759 - DNA, 1167 bp, Artificial Sequence
  Variant of Leucine Decarboxylase from Planctomycetaceae bacterium
atgggtaatctgaaatttccagatggcgcgttgagcccgaccgaccaacgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgcaagctccagttatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctacgtttcggaagattcgcattatagcgtgtataagaatctgcgtctgctgaacatgcgtcacatcatgatcaaatcacagccgaatggtgagattgattacggcgatctctacgaaactatgcgcgctcatcgtgataagccgccgatcatcttcgctaacattggtacgacgatgaccgaaggcattgacaacgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgtgccattaccgttgtgttcccgaaacctccgcagtcagtgctggaaaagtggcaaatcgcaaccgagggcgacgatgcgcatatttgcttaatgccaagtaccacccgtcagatggtcgatgaattgatcgctgacattgcggccgccaataaagaagctgcggcaccgagcgatacggccaag

SEQ ID NO: 760 - protein, 389 aa, Artificial Sequence
  Variant of Leucine Decarboxylase from Planctomycetaceae bacterium
MGNLKFPDGALSPTDQRRLEDVYQYVREQCDTFIGYPCNMHFDYTPLFPFLAYPVNNVGDPFASSSYRIHTREIEREVLAWFAELMHIAPEEYWGYVTNGGSEGNLYGLFLARERFPTGVAYVSEDSHYSVYKNLRLLNMRHIMIKSQPNGEIDYGDLYETMRAHRDKPPIIFANIGTTMTEGIDNVRTIQDMFKKLAIHESHIHCDAALAGMTLPFMDDAPAFDFATGIDSLSISGHKFIGSPMPCGIVLTRKPYVEKIATSIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTRQMVDELIADIAAANKEAAAPSDTAK

SEQ ID NO: 761 - DNA, 1167 bp, Artificial Sequence
  Variant of Leucine Decarboxylase from Planctomycetaceae bacterium
atgggtaatctgaaatttccagatggcgcgttgagcccgaccgaccaacgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgcaagctccagttatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagattcgcattatagcgtgtataagaatctgcgtctgctgaacatgcgtcacatcatgatcaaatcacagccgaatggtgagattgattacggcgatctctacgaaactatgcgcgctcatcgtgataagccgccgatcatcgcggctaacattggtacgacgatgaccgaaggcattgacaacgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgtgccattaccgttgtgttcccgaaacctccgcagtcagtgctggaaaagtggcaaatcgcaaccgagggcgacgatgcgcatatttgcttaatgccaagtaccacccgtcagatggtcgatgaattgatcgctgacattgcggccgccaataaagaagctgcggcaccgagcgatacggccaag

SEQ ID NO: 762 - protein, 389 aa, Artificial Sequence
  Variant of Leucine Decarboxylase from Planctomycetaceae bacterium
MGNLKFPDGALSPTDQRRLEDVYQYVREQCDTFIGYPCNMHFDYTPLFPFLAYPVNNVGDPFASSSYRIHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDKPPIIAANIGTTMTEGIDNVRTIQDMFKKLAIHESHIHCDAALAGMTLPFMDDAPAFDFATGIDSLSISGHKFIGSPMPCGIVLTRKPYVEKIATSIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTRQMVDELIADIAAANKEAAAPSDTAK

SEQ ID NO: 763 - DNA, 1167 bp, Artificial Sequence
  Variant of Leucine Decarboxylase from Planctomycetaceae bacterium
atgggtaatctgaaatttccagatggcgcgttgagcccgaccgaccaacgccgtattgaagatgtgtatcagtacgttcgtgagcaatgcgacaccttcatcgggtatccgtgcaacatgcactttgattacacacctctttttccgttcctggcctatcccgtcaacaacgtgggcgatccgtttgcaagctccaactatcgcatccatacccgtgaaatcgaacgcgaggttctggcgtggttcgccgaactcatgcacattgcaccagaagaatactggggttatgtgactaatggaggatcggagggcaacctgtacggtggctttttagcgcgtgaacgctttcctgatggcgtcgcctactattcggaagattcgcattatagcgtgtataagaatctgcgtctgctgaacatgcgtcacatcatgatcaaatcacagccgaatggtgagattgattacggcgatctctacgaaactatgcgcgctcatcgtgataagccgccaatcatctttgctaacattggtacgacgatgaccgaaggcattgacaacgtgcgcaccatccaggatatgttcaagaagctggcgattcacgaatctcatatccattgtgacgcagcattatcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatatcggtacccgcgacactacgatttcgggcagccgtaatggtattacaccgctgtttctttggtacgcggtgaaacaagctggacgcgaaggcttcaaaaagcgtgttgcggcatgtctggataacgcccgctatgccgtcgagcagtttaaacgcatcggtgtagaagcgatgcgtaatccatgtgccattaccgttgtgttcccgaaacctccgcagtcagtgctggaaaagtggcaaatcgcaaccgagggcgacgatgcgcatatttgcttaatgccaagtaccacccgtcagatggtcgatgaattgatcgctgacattgcggccgccaataaagaagctgcggcaccgagcgatacggccaag

SEQ ID NO: 764 - protein, 389 aa, Artificial Sequence
  Variant of Leucine Decarboxylase from Planctomycetaceae bacterium
MGNLKFPDGALSPTDQRRIEDVYQYVREQCDTFIGYPCNMHFDYTPLFPFLAYPVNNVGDPFASSNYRIHTREIEREVLAWFAELMHIAPEEYWGYVTNGGSEGNLYGGFLARERFPDGVAYYSEDSHYSVYKNLRLLNMRHIMIKSQPNGEIDYGDLYETMRAHRDKPPIIFANIGTTMTEGIDNVRTIQDMFKKLAIHESHIHCDAALSGMTLPFMDDAPAFDFATGIDSLSISGHKFIGSPMPCGIVLTRKPYVEKIATSIEYIGTRDTTISGSRNGITPLFLWYAVKQAGREGFKKRVAACLDNARYAVEQFKRIGVEAMRNPCAITVVFPKPPQSVLEKWQIATEGDDAHICLMPSTTRQMVDELIADIAAANKEAAAPSDTAK

SEQ ID NO: 765 - DNA, 1167 bp, Artificial Sequence
  Variant of Leucine Decarboxylase from Planctomycetaceae bacterium
atgggtaatctgaaatttccagatggcgcgttgagcccgaccgaccaacgccgtattgaagatgtgtatcagtacgttcgtgagcaatgcgacaccttcatcgggtatccgtgcaacatgcactttgattacacacctctttttccgttcctggcctatcccgtcaacaacgtgggcgatccgtttgcaagctccaactatcgcatccatacccgtgaaatcgaacgcgaggttctggcgtggttcgccgaactcatgcacattgcaccagaagaatactggggttatgtgactaatggaggatcggagggcaacctgtacggtggctttttagcgcgtgaacgctttcctgatggcgtcgcctacttctcggaagattcgcattatagcgtgtataagaatctgcgtctgctgaacatgcgtcacatcatgatcaaatcacagccgaatggtgagattgattacggcgatctctacgaaactatgcgcgctcatcgtgataagccggcaatcatctttgctaacattggtacgacgatgaccgaaggcattgacaacgtgcgcaccatccaggatatgttcaagaagctggcgattcacgaatctcatatccattgtgacgcagcattatcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatatcggtacccgcgacactacgatttcgggcagccgtaatggtattacaccgctgtttctttggtacgcggtgaaacaagctggacgcgaaggcttcaaaaagcgtgttgcggcatgtctggataacgcccgctatgccgtcgagcagtttaaacgcatcggtgtagaagcgatgcgtaatccatgtgccattaccgttgtgttcccgaaacctccgcagtcagtgctggaaaagtggcaaatcgcaaccgagggcgacgatgcgcatatttgcttaatgccaagtaccacccgtcagatggtcgatgaattgatcgctgacattgcggccgccaataaagaagctgcggcaccgagcgatacggccaag

SEQ ID NO: 766 - protein, 389 aa, Artificial Sequence
  Variant of Leucine Decarboxylase from Planctomycetaceae bacterium
MGNLKFPDGALSPTDQRRIEDVYQYVREQCDTFIGYPCNMHFDYTPLFPFLAYPVNNVGDPFASSNYRIHTREIEREVLAWFAELMHIAPEEYWGYVTNGGSEGNLYGGFLARERFPDGVAYFSEDSHYSVYKNLRLLNMRHIMIKSQPNGEIDYGDLYETMRAHRDKPAIIFANIGTTMTEGIDNVRTIQDMFKKLAIHESHIHCDAALSGMTLPFMDDAPAFDFATGIDSLSISGHKFIGSPMPCGIVLTRKPYVEKIATSIEYIGTRDTTISGSRNGITPLFLWYAVKQAGREGFKKRVAACLDNARYAVEQFKRIGVEAMRNPCAITVVFPKPPQSVLEKWQIATEGDDAHICLMPSTTRQMVDELIADIAAANKEAAAPSDTAK

SEQ ID NO: 767 - DNA, 1167 bp, Artificial Sequence
  Variant of Leucine Decarboxylase from Planctomycetaceae bacterium
atgggtaatctgaaatttccagatggcgcgttgagcccgaccgaccaacgccgtattgaagatgtgtatcagtacgttcgtgagcaatgcgacaccttcatcgggtatccgtgcaacatgcactttgattacacacctctttttccgttcctggcctatcccgtcaacaacgtgggcgatccgtttgcaagctccaactatcgcatccatacccgtgaaatcgaacgcgaggttctggcgtggttcgccgaactcatgcacattgcaccagaagaatactggggttatgtgactaatggaggatcggagggcaacctgtacggtggctttttagcgcgtgaacgctttcctgatggcgtcgcctacgtctcggaagattcgcattatagcgtgtataagaatctgcgtctgctgaacatgcctcacatcatgatcaaatcacagccgaatggtgagattgattacggcgatctctacgaaactatgcgcgctcatcgtgataagccggcaatcatctttgctaacattggtacgacgatgaccgaaggcattgacaacgtgcgcaccatccaggatatgttcaagaagctgggtattcatgaatctcatatccattgtgacgcagcattatcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatatcggtacccgcgacactacgatttcgggcagccgtaatggtattacaccgctgtttctttggtacgcggtgaaacaagctggacgcgaaggcttcaaaaagcgtgttgcggcatgtctggataacgcccgctatgccgtcgagcagtttaaacgcatcggtgtagaagcgatgcgtaatccatgtgccattaccgttgtgttcccgaaacctccgcagtcagtgctggaaaagtggcaaatcgcaaccgagggcgacgatgcgcatatttgcttaatgccaagtaccacccgtcagatggtcgatgaattgatcgctgacattgcggccgccaataaagaagctgcggcaccgagcgatacggccaag

SEQ ID NO: 768 - protein, 389 aa, Artificial Sequence
  Variant of Leucine Decarboxylase from Planctomycetaceae bacterium
MGNLKFPDGALSPTDQRRIEDVYQYVREQCDTFIGYPCNMHFDYTPLFPFLAYPVNNVGDPFASSNYRIHTREIEREVLAWFAELMHIAPEEYWGYVTNGGSEGNLYGGFLARERFPDGVAYVSEDSHYSVYKNLRLLNMPHIMIKSQPNGEIDYGDLYETMRAHRDKPAIIFANIGTTMTEGIDNVRTIQDMFKKLGIHESHIHCDAALSGMTLPFMDDAPAFDFATGIDSLSISGHKFIGSPMPCGIVLTRKPYVEKIATSIEYIGTRDTTISGSRNGITPLFLWYAVKQAGREGFKKRVAACLDNARYAVEQFKRIGVEAMRNPCAITVVFPKPPQSVLEKWQIATEGDDAHICLMPSTTRQMVDELIADIAAANKEAAAPSDTAK

SEQ ID NO: 769 - DNA, 1167 bp, Artificial Sequence
  Variant of Leucine Decarboxylase from Planctomycetaceae bacterium
atgggtaatctgaaatttccagatggcgcgttgagcccgaccgaccaacgccgtattgaagatgtgtatcagtacgttcgtgagcaatgcgacaccttcatcgggtatccgtgcaacatgcactttgattacacacctctttttccgttcctggcctatcccgtcaacaacgtgggcgatccgtttgcaagctccaactatcgcatccatacccgtgaaatcgaacgcgaggttctggcgtggttcgccgaactcatgcacattgcaccagaagaatactggggttatgtgactaatggaggatcggagggcaacctgtacggtggctttttagcgcgtgaacgctttcctgatggcgtcgcctactattcggaagattcgcattatagcgtgtataagaatctgcgtctgctgaacatgcgtcacatcatgatcaaatcacagccgaatggtgagattgattacggcgatctctacgaaactatgcgcgctcatcgtgataagccggcaatcatcattgctaacattggtacgacgatgaccgaaggcattgacaacgtgcgcaccatccaggatatgttcaagaagctggcgattcacgaatctcatatccattgtgacgcagcattatcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatatcggtacccgcgacactacgatttcgggcagccgtaatggtattacaccgctgtttctttggtacgcggtgaaacaagctggacgcgaaggcttcaaaaagcgtgttgcggcatgtctggataacgcccgctatgccgtcgagcagtttaaacgcatcggtgtagaagcgatgcgtaatccatgtgccattaccgttgtgttcccgaaacctccgcagtcagtgctggaaaagtggcaaatcgcaaccgagggcgacgatgcgcatatttgcttaatgccaagtaccacccgtcagatggtcgatgaattgatcgctgacattgcggccgccaataaagaagctgcggcaccgagcgatacggccaag

SEQ ID NO: 770 - protein, 389 aa, Artificial Sequence
  Variant of Leucine Decarboxylase from Planctomycetaceae bacterium
MGNLKFPDGALSPTDQRRIEDVYQYVREQCDTFIGYPCNMHFDYTPLFPFLAYPVNNVGDPFASSNYRIHTREIEREVLAWFAELMHIAPEEYWGYVTNGGSEGNLYGGFLARERFPDGVAYYSEDSHYSVYKNLRLLNMRHIMIKSQPNGEIDYGDLYETMRAHRDKPAIIIANIGTTMTEGIDNVRTIQDMFKKLAIHESHIHCDAALSGMTLPFMDDAPAFDFATGIDSLSISGHKFIGSPMPCGIVLTRKPYVEKIATSIEYIGTRDTTISGSRNGITPLFLWYAVKQAGREGFKKRVAACLDNARYAVEQFKRIGVEAMRNPCAITVVFPKPPQSVLEKWQIATEGDDAHICLMPSTTRQMVDELIADIAAANKEAAAPSDTAK

SEQ ID NO: 771 - DNA, 1167 bp, Artificial Sequence
  Variant of Leucine Decarboxylase from Planctomycetaceae bacterium
atgggtaatctgaaatttccagatggcgcgttgagcccgaccgaccaacgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgcaagctccaactatcgcatccatacccgtgaaatcgaacgcgaggttctggcgtggttcgccgaactcatgcacattgcaccagaagaatactggggttatgtgactaatggaggatcggagggcaacctgtacggtggctttttagcgcgtgaacgctttcctgatggcgtcgcctactattcggaagattcgcattatagcgtgtataagaatctgcgtctgctgaacatgcgtcacatcatgatcaaatcacagccgaatggtgagattgattacggcgatctctacgaaactatgcgcgctcatcgtgataagccgccaatcatctttgctaacattggtacgacgatgaccgaaggcattgacaacgtgcgcaccatccaggatatgttcaagaagctggcgattcatgaatctcatatccattgtgacgcagcattatcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatatcggtacccgcgacactacgatttcgggcagccgtaatggtattacaccgctgtttctttggtacgcggtgaaacaagctggacgcgaaggcttcaaaaagcgtgttgcggcatgtctggataacgcccgctatgccgtcgagcagtttaaacgcatcggtgtagaagcgatgcgtaatccatgtgccattaccgttgtgttcccgaaacctccgcagtcagtgctggaaaagtggcaaatcgcaaccgagggcgacgatgcgcatatttgcttaatgccaagtaccacccgtcagatggtcgatgaattgatcgctgacattgcggccgccaataaagaagctgcggcaccgagcgatacggccaag

SEQ ID NO: 772 - protein, 389 aa, Artificial Sequence
  Variant of Leucine Decarboxylase from Planctomycetaceae bacterium
MGNLKFPDGALSPTDQRRLEDVYQYVREQCDTFIGYPCNMHFDYTPLFPFLAYPVNNVGDPFASSNYRIHTREIEREVLAWFAELMHIAPEEYWGYVTNGGSEGNLYGGFLARERFPDGVAYYSEDSHYSVYKNLRLLNMRHIMIKSQPNGEIDYGDLYETMRAHRDKPPIIFANIGTTMTEGIDNVRTIQDMFKKLAIHESHIHCDAALSGMTLPFMDDAPAFDFATGIDSLSISGHKFIGSPMPCGIVLTRKPYVEKIATSIEYIGTRDTTISGSRNGITPLFLWYAVKQAGREGFKKRVAACLDNARYAVEQFKRIGVEAMRNPCAITVVFPKPPQSVLEKWQIATEGDDAHICLMPSTTRQMVDELIADIAAANKEAAAPSDTAK

SEQ ID NO: 773 - DNA, 1167 bp, Artificial Sequence
  Variant of Leucine Decarboxylase from Planctomycetaceae bacterium
atgggtaatctgaaatttccagatggcgcgttgagcccgaccgaccaacgccgtattgaagatgtgtatcagtacgttcgtgagcaatgcgacaccttcatcgggtatccgtgcaacatgcactttgattacacacctctttttccgttcctggcctatcccgtcaacaacgtgggcgatccgtttgcaagctccaactatcgcatccatacccgtgaaatcgaacgcgaggttctggcgtggttcgccgaactcatgcacattgcaccagaagaatactggggttatgtgactaatggaggatcggagggcaacctgtacggtggctttttagcgcgtgaacgctttcctgatggcgtcgcctacttctcggaagattcgcattatagcgtgtataagaatctgcgtctgctgaacatgcgtcacatcatgatcaaatcacagccgaatggtgagattgattacggcgatctctacgaaactatgcgcgctcatcgtgataagccgccgatcatcttcgctaacattggtacgacgatgaccgaaggcattgacaacgtgcgcaccatccaggatatgttcaagaagctgggtattagtgaatctcatatccattgtgacgcagcattatcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatatcggtacccgcgacactacgatttcgggcagccgtaatggtattacaccgctgtttctttggtacgcggtgaaacaagctggacgcgaaggcttcaaaaagcgtgttgcggcatgtctggataacgcccgctatgccgtcgagcagtttaaacgcatcggtgtagaagcgatgcgtaatccatgtgccattaccgttgtgttcccgaaacctccgcagtcagtgctggaaaagtggcaaatcgcaaccgagggcgacgatgcgcatatttgcttaatgccaagtaccacccgtcagatggtcgatgaattgatcgctgacattgcggccgccaataaagaagctgcggcaccgagcgatacggccaag

SEQ ID NO: 774 - protein, 389 aa, Artificial Sequence
  Variant of Leucine Decarboxylase from Planctomycetaceae bacterium
MGNLKFPDGALSPTDQRRIEDVYQYVREQCDTFIGYPCNMHFDYTPLFPFLAYPVNNVGDPFASSNYRIHTREIEREVLAWFAELMHIAPEEYWGYVTNGGSEGNLYGGFLARERFPDGVAYFSEDSHYSVYKNLRLLNMRHIMIKSQPNGEIDYGDLYETMRAHRDKPPIIFANIGTTMTEGIDNVRTIQDMFKKLGISESHIHCDAALSGMTLPFMDDAPAFDFATGIDSLSISGHKFIGSPMPCGIVLTRKPYVEKIATSIEYIGTRDTTISGSRNGITPLFLWYAVKQAGREGFKKRVAACLDNARYAVEQFKRIGVEAMRNPCAITVVFPKPPQSVLEKWQIATEGDDAHICLMPSTTRQMVDELIADIAAANKEAAAPSDTAK

SEQ ID NO: 775 - DNA, 1167 bp, Artificial Sequence
  Variant of Leucine Decarboxylase from Planctomycetaceae bacterium
atgggtaatctgaaatttccagatggcgcgttgagcccgaccgaccaacgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgcaagctccaactatcgcatccatacccgtgaaatcgaacgcgaggttctggcgtggttcgccgaactcatgcacattgcaccagaagaatactggggttatgtgactaatggaggatcggagggcaacctgtacggtggctttttagcgcgtgaacgctttcctgatggcgtcgcctactattcggaagattcgcattatagcgtgtataagaatctgcgtctgctgaacatgcgtcacatcatgatcaaatcacagccgaatggtgagattgattacggcgatctctacgaaactatgcgcgctcatcgtgataagccggcaatcatctttgctaacattggtacgacgatgaccgaaggcattgacaacgtgcgcaccatccaggatatgttcaagaagctggcgattcacgaatctcatatccattgtgacgcagcattatcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatatcggtacccgcgacactacgatttcgggcagccgtaatggtattacaccgctgtttctttggtacgcggtgaaacaagctggacgcgaaggcttcaaaaagcgtgttgcggcatgtctggataacgcccgctatgccgtcgagcagtttaaacgcatcggtgtagaagcgatgcgtaatccatgtgccattaccgttgtgttcccgaaacctccgcagtcagtgctggaaaagtggcaaatcgcaaccgagggcgacgatgcgcatatttgcttaatgccaagtaccacccgtcagatggtcgatgaattgatcgctgacattgcggccgccaataaagaagctgcggcaccgagcgatacggccaag

SEQ ID NO: 776 - protein, 389 aa, Artificial Sequence
  Variant of Leucine Decarboxylase from Planctomycetaceae bacterium
MGNLKFPDGALSPTDQRRLEDVYQYVREQCDTFIGYPCNMHFDYTPLFPFLAYPVNNVGDPFASSNYRIHTREIEREVLAWFAELMHIAPEEYWGYVTNGGSEGNLYGGFLARERFPDGVAYYSEDSHYSVYKNLRLLNMRHIMIKSQPNGEIDYGDLYETMRAHRDKPAIIFANIGTTMTEGIDNVRTIQDMFKKLAIHESHIHCDAALSGMTLPFMDDAPAFDFATGIDSLSISGHKFIGSPMPCGIVLTRKPYVEKIATSIEYIGTRDTTISGSRNGITPLFLWYAVKQAGREGFKKRVAACLDNARYAVEQFKRIGVEAMRNPCAITVVFPKPPQSVLEKWQIATEGDDAHICLMPSTTRQMVDELIADIAAANKEAAAPSDTAK

SEQ ID NO: 777 - DNA, 1167 bp, Artificial Sequence
  Variant of Leucine Decarboxylase from Planctomycetaceae bacterium
atgggtaatctgaaatttccagatggcgcgttgagcccgaccgaccaacgccgtattgaagatgtgtatcagtacgttcgtgagcaatgcgacaccttcatcgggtatccgtgcaacatgcactttgattacacacctctttttccgttcctggcctatcccgtcaacaacgtgggcgatccgtttgcaagctccaactatcgcatccatacccgtgaaatcgaacgcgaggttctggcgtggttcgccgaactcatgcacattgcaccagaagaatactggggttatgtgactaatggaggatcggagggcaacctgtacggtggctttttagcgcgtgaacgctttcctgatggcgtcgcctacgtctcggaagattcgcattatagcgtgtataagaatctgcgtctgctgaacatgcctcacatcatgatcaaatcacagccgaatggtgagattgattacggcgatctctacgaaactatgcgcgctcatcgtgataagccggcaatcatctttgctaacattggtacgacgatgaccgaaggcattgacaacgtgcgcaccatccaggatatgttcaagaagctgggtattagtgaatctcatatccattgtgacgcagcattatcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatatcggtacccgcgacactacgatttcgggcagccgtaatggtattacaccgctgtttctttggtacgcggtgaaacaagctggacgcgaaggcttcaaaaagcgtgttgcggcatgtctggataacgcccgctatgccgtcgagcagtttaaacgcatcggtgtagaagcgatgcgtaatccatgtgccattaccgttgtgttcccgaaacctccgcagtcagtgctggaaaagtggcaaatcgcaaccgagggcgacgatgcgcatatttgcttaatgccaagtaccacccgtcagatggtcgatgaattgatcgctgacattgcggccgccaataaagaagctgcggcaccgagcgatacggccaag

SEQ ID NO: 778 - protein, 389 aa, Artificial Sequence
  Variant of Leucine Decarboxylase from Planctomycetaceae bacterium
MGNLKFPDGALSPTDQRRIEDVYQYVREQCDTFIGYPCNMHFDYTPLFPFLAYPVNNVGDPFASSNYRIHTREIEREVLAWFAELMHIAPEEYWGYVTNGGSEGNLYGGFLARERFPDGVAYVSEDSHYSVYKNLRLLNMPHIMIKSQPNGEIDYGDLYETMRAHRDKPAIIFANIGTTMTEGIDNVRTIQDMFKKLGISESHIHCDAALSGMTLPFMDDAPAFDFATGIDSLSISGHKFIGSPMPCGIVLTRKPYVEKIATSIEYIGTRDTTISGSRNGITPLFLWYAVKQAGREGFKKRVAACLDNARYAVEQFKRIGVEAMRNPCAITVVFPKPPQSVLEKWQIATEGDDAHICLMPSTTRQMVDELIADIAAANKEAAAPSDTAK

SEQ ID NO: 779 - DNA, 1167 bp, Artificial Sequence
  Variant of Leucine Decarboxylase from Planctomycetaceae bacterium
atgggtaatctgaaatttccagatggcgcgttgagcccgaccgaccaacgccgtattgaagatgtgtatcagtacgttcgtgagcaatgcgacaccttcatcgggtatccgtgcaacatgcactttgattacacacctctttttccgttcctggcctatcccgtcaacaacgtgggcgatccgtttgcaagctccaactatcgcatccatacccgtgaaatcgaacgcgaggttctggcgtggttcgccgaactcatgcacattgcaccagaagaatactggggttatgtgactaatggaggatcggagggcaacctgtacggtggctttttagcgcgtgaacgctttcctgatggcgtcgcctacgtctcggaagattcgcattatagcgtgtataagaatctgcgtctgctgaacatgcctcacatcatgatcaaatcacagccgaatggtgagattgattacggcgatctctacgaaactatgcgcgctcatcgtgataagccggcaatcatctttgctaacattggtacgacgatgaccgaaggcattgacaacgtgcgcaccatccaggatatgttcaagaagctgggtattcatgaatctcatatccattgtgacgcagcattatcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatatcggtaccctggacactacgatttcgggcagccgtaatggtattacaccgctgtttctttggtacgcggtgaaacaagctggacgcgaaggcttcaaaaagcgtgttgcggcatgtctggataacgcccgctataccgtcgagcagtttaaacgcatcggtgtagaagcgatgcgtaatccatgtgccattaccgttgtgttcccgaaacctccgcagtcagtgctggaaaagtggcaaatcgcaaccgagggcgacgatgcgcatatttgcttaatgccaagtaccacccgtcagatggtcgatgaattgatcgctgacattgcggccgccaataaagaagctgcggcaccgagcgatacggccaag

SEQ ID NO: 780 - protein, 389 aa, Artificial Sequence
  Variant of Leucine Decarboxylase from Planctomycetaceae bacterium
MGNLKFPDGALSPTDQRRIEDVYQYVREQCDTFIGYPCNMHFDYTPLFPFLAYPVNNVGDPFASSNYRIHTREIEREVLAWFAELMHIAPEEYWGYVTNGGSEGNLYGGFLARERFPDGVAYVSEDSHYSVYKNLRLLNMPHIMIKSQPNGEIDYGDLYETMRAHRDKPAIIFANIGTTMTEGIDNVRTIQDMFKKLGIHESHIHCDAALSGMTLPFMDDAPAFDFATGIDSLSISGHKFIGSPMPCGIVLTRKPYVEKIATSIEYIGTLDTTISGSRNGITPLFLWYAVKQAGREGFKKRVAACLDNARYTVEQFKRIGVEAMRNPCAITVVFPKPPQSVLEKWQIATEGDDAHICLMPSTTRQMVDELIADIAAANKEAAAPSDTAK

SEQ ID NO: 781 - DNA, 1167 bp, Artificial Sequence
  Variant of Leucine Decarboxylase from Planctomycetaceae bacterium
atgggtaatctggtctttccagatggcgcgttgagcccgaccgaccaacgccgtattgaagatgtgtatcagtacgttcgtgagcaatgcgacaccttcatcgggtatccgtgcaacatggactttgattacacacctctttttccgttcctggcctatcccgtcaacaacgtgggcgatccgtttgcaagctccaactatcgcatccatacccgtgaaatcgaacgcgaggttctggcgtggttcgccgaactcatgcacattgcaccagaagaatactggggttatgtgactaatggaggatcggagggcaacctgtacggtggctttttagcgcgtgaacgctttcctgatggcgtcgcctacttctcggaagattcgcattatagcgtgtataagaatctgcgtctgctgaacatgcgtcacatcatgatcaaatcacagccgaatggtgagattgattacggcgatctctacgaaactatgcgcgctcatcgtgataagccggcaatcatctttgctaacattggtacgacgatgaccgaaggcatcgacaacgtgcgcaccatccaggatatgttcaagaagctggcgattcacgaatctcatatccattgtgacgcagcattatcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatatcggtacccgcgacaccacgatttcgggcagccgtaatggtattacaccgctgtttctttggtacgcggtgaaacaagctggacgcgaaggcttcaaaaagcgtgttgcggcatgtctggataacgcccgctatgccgtcgagcagtttaaacgcatcggtgtagaagcgatgcgtaatccatgtgccattaccgttgtgttcccgaaacctccgcagtcagtgctggaaaagtggcaaatcgcaaccgagggcgacgatgcgcatatttgcttaatgccaagtaccacccgtcagatggtcgatgaattgatcgctgacattgcggccgccaataaagaagctgcggcaccgagcgatacggccaag

SEQ ID NO: 782 - protein, 389 aa, Artificial Sequence
  Variant of Leucine Decarboxylase from Planctomycetaceae bacterium
MGNLVFPDGALSPTDQRRIEDVYQYVREQCDTFIGYPCNMDFDYTPLFPFLAYPVNNVGDPFASSNYRIHTREIEREVLAWFAELMHIAPEEYWGYVTNGGSEGNLYGGFLARERFPDGVAYFSEDSHYSVYKNLRLLNMRHIMIKSQPNGEIDYGDLYETMRAHRDKPAIIFANIGTTMTEGIDNVRTIQDMFKKLAIHESHIHCDAALSGMTLPFMDDAPAFDFATGIDSLSISGHKFIGSPMPCGIVLTRKPYVEKIATSIEYIGTRDTTISGSRNGITPLFLWYAVKQAGREGFKKRVAACLDNARYAVEQFKRIGVEAMRNPCAITVVFPKPPQSVLEKWQIATEGDDAHICLMPSTTRQMVDELIADIAAANKEAAAPSDTAK

SEQ ID NO: 783 - DNA, 1167 bp, Artificial Sequence
  Variant of Leucine Decarboxylase from Planctomycetaceae bacterium
atgggtaatctggtctttccagatggcgcgttgagcccgaccgaccaacgccgtattgaagatgtgtatcagtacgttcgtgagcaatgcgacaccttcatcgggtatccgtgcaacatggactttgattacacacctctttttccgttcctggcctatcccgtcaacaacgtgggcgatccgtttgcaagctccaactatcgcatccatacccgtgaaatcgaacgcgaggttctggcgtggttcgccgaactcatgcacattgcaccagaagaatactggggttatgtgactaatggaggatcggagggcaacctgtacggtggctttttagcgcgtgaacgctttcctgatggcgtcgcctacttctcggaagattcgcattatagcgtgtataagaatctgcgtctgctgaacatgcgtcacatcatgatcaaatcacagccgaatggtgagattgattacggcgatctctacgaaactatgcgcgctcatcgtgataagccggcaatcatctttgctaacattggtacgacgatgaccgaaggcatcgacaacgtgcgcaccatccaggatatgttcaagaagctggcgattcacgaatctcatatccattgtgacgcagcattatcggggatgaccctgccctttatggatgatgccccagcgtttgactttgccgatggcattgattcgcttagcatctccggtcacaaattcattgggtctccgatgccttgcggcatcgttttgacacgcaaaccttatgtggagaaaattgctacttcgattgaatatatcggtacccgcgacaccacgatttcgggcagccgtaatggtattacaccgctgtttctttggtacgcggtgaaacaagctggacgcgaaggcttcaaaaagcgtgttgcggcatgtctggataacgcccgctatgccgtcgagcagtttaaacgcatcggtgtagaagcgatgcgtaatccatgtgccattaccgttgtgttcccgaaacctccgcagtcagtgctggaaaagtggcaaatcgcaaccgagggcgacgatgcgcatatttgcttaatgccaagtaccacccgtcagatggtcgatgaattgatcgctgacattgcggccgccaataaagaagctgcggcaccgagcgatacggccaag

SEQ ID NO: 784 - protein, 389 aa, Artificial Sequence
  Variant of Leucine Decarboxylase from Planctomycetaceae bacterium
MGNLVFPDGALSPTDQRRIEDVYQYVREQCDTFIGYPCNMDFDYTPLFPFLAYPVNNVGDPFASSNYRIHTREIEREVLAWFAELMHIAPEEYWGYVTNGGSEGNLYGGFLARERFPDGVAYFSEDSHYSVYKNLRLLNMRHIMIKSQPNGEIDYGDLYETMRAHRDKPAIIFANIGTTMTEGIDNVRTIQDMFKKLAIHESHIHCDAALSGMTLPFMDDAPAFDFADGIDSLSISGHKFIGSPMPCGIVLTRKPYVEKIATSIEYIGTRDTTISGSRNGITPLFLWYAVKQAGREGFKKRVAACLDNARYAVEQFKRIGVEAMRNPCAITVVFPKPPQSVLEKWQIATEGDDAHICLMPSTTRQMVDELIADIAAANKEAAAPSDTAK

SEQ ID NO: 785 - DNA, 1167 bp, Artificial Sequence
  Variant of Leucine Decarboxylase from Planctomycetaceae bacterium
atgggtaatctgaagtttccagatggcgcgttgagcccgaccgaccaacgccgtattgaagatgtgtatcagtacgttcgtgagcaatgcgacaccttcatcgggtatccgtgcaacatggactttgattacacacctctttttccgttcctggcctatcccgtcaacaacgtgggcgatccgtttgcaagctccaactatcgcatccatacccgtgaaatcgaacgcgaggttctggcgtggttcgccgaactcatgcacattgcaccagaagaatactggggttatgtgactaatggaggatcggagggcaacctgtacggtggctttttagcgcgtgaacgctttcctgatggcgtcgcctacttctcggaagattcgcattatagcgtgtataagaatctgcgtctgctgaacatgcgtcacatcatgatcaaatcacagccgaatggtgagattgattacggcgatctctacgaaactatgcgcgctcatcgtgataagccggcaatcatctttgctaacattggtacgacgatgaccgaaggcatcgacaacgtgcgcaccatccaggatatgttcaagaagctggcgattcacgaatctcatatccattgtgacgcagcattatcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatatcggtacccgcgacaccacgatttcgggcagccgtaatggtattacaccgctgtttctttggtacgcggtgaaacaagctggacgcgaaggcttcaaaaagcgtgttgcggcatgtctggataacgcccgctatgccgtcgagcagtttaaacgcatcggtgtagaagcgatgcgtaatccatgtgccattaccgttgtgttcccgaaacctccgcagtcagtgctggaaaagtggcaaatcgcaaccgagggcgacgatgcgcatatttgcttaatgccaagtaccacccgtcagatggtcgatgaattgatcgctgacattgcggccgccaataaagaagctgcggcaccgagcgatacggccaag

SEQ ID NO: 786 - protein, 389 aa, Artificial Sequence
  Variant of Leucine Decarboxylase from Planctomycetaceae bacterium
MGNLKFPDGALSPTDQRRIEDVYQYVREQCDTFIGYPCNMDFDYTPLFPFLAYPVNNVGDPFASSNYRIHTREIEREVLAWFAELMHIAPEEYWGYVTNGGSEGNLYGGFLARERFPDGVAYFSEDSHYSVYKNLRLLNMRHIMIKSQPNGEIDYGDLYETMRAHRDKPAIIFANIGTTMTEGIDNVRTIQDMFKKLAIHESHIHCDAALSGMTLPFMDDAPAFDFATGIDSLSISGHKFIGSPMPCGIVLTRKPYVEKIATSIEYIGTRDTTISGSRNGITPLFLWYAVKQAGREGFKKRVAACLDNARYAVEQFKRIGVEAMRNPCAITVVFPKPPQSVLEKWQIATEGDDAHICLMPSTTRQMVDELIADIAAANKEAAAPSDTAK

SEQ ID NO: 787 - DNA, 1167 bp, Artificial Sequence
  Variant of Leucine Decarboxylase from Planctomycetaceae bacterium
atgggtaatctgaaatttccagatggcgcgttgagcccgaccgaccaacgccgtattgaagatgtgtatcagtacgttcgtgagcaatgcgacaccttcatcgggtatccgtgcaacatgcactttgattacacacctctttttccgttcctggcctatcccgtcaacaacgtgggcgatccgtttgcaagctccaactatcgcatccatacccgtgaaatcgaacgcgaggttctggcgtggttcgccgaactcatgcacattgcaccagaagaatactggggttatgtgactaatggaggatcggagggcaacctgtacggtggctttttagcgcgtgaacgctttcctgatggcgtcgcctacttctcggaagattcgcattatagcgtgtataagaatctgcgtctgctgaacatgcgtcacatcatgatcaaatcacagccgaatggtgagattgattacggcgatctctacgaaactatgcgcgctcatcgtgataagccggcaatcatctttgctaacattggtacgacgatgaccgaaggcattgacaacgtgcgcaccatccaggatatgttcaagaagctggcgattcacgaatctcatatccattgtgacgcagcattatcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatatcggtacccgcgacactacgatttcgggcagccgtaatggtattacaccgctgtttctttggtacgcggtgaaacaagctggacgcgaaggcttcaaaaagcgtgttgcggcatgtctggataacgcccgctatgccgtcgagcagtttaaacgcatcggtgtagaagcgatgcgtaatccatgtgccattgtggttgtgttcccgaaacctccgcagtcagtgctggaaaagtggcaaatcgcaaccgagggcgacgatgcgcatatttgcttaatgccaagtaccacccgtcagatggtcgatgaattgatcgctgacattgcggccgccaataaagaagctgcggcaccgagcgatacggccaag

SEQ ID NO: 788 - protein, 389 aa, Artificial Sequence
  Variant of Leucine Decarboxylase from Planctomycetaceae bacterium
MGNLKFPDGALSPTDQRRIEDVYQYVREQCDTFIGYPCNMHFDYTPLFPFLAYPVNNVGDPFASSNYRIHTREIEREVLAWFAELMHIAPEEYWGYVTNGGSEGNLYGGFLARERFPDGVAYFSEDSHYSVYKNLRLLNMRHIMIKSQPNGEIDYGDLYETMRAHRDKPAIIFANIGTTMTEGIDNVRTIQDMFKKLAIHESHIHCDAALSGMTLPFMDDAPAFDFATGIDSLSISGHKFIGSPMPCGIVLTRKPYVEKIATSIEYIGTRDTTISGSRNGITPLFLWYAVKQAGREGFKKRVAACLDNARYAVEQFKRIGVEAMRNPCAIVVVFPKPPQSVLEKWQIATEGDDAHICLMPSTTRQMVDELIADIAAANKEAAAPSDTAK

SEQ ID NO: 789 - DNA, 1167 bp, Artificial Sequence
  Variant of Leucine Decarboxylase from Planctomycetaceae bacterium
atgggtaatctgaaatttccagatggcgcgttgagcccgaccgaccaacgccgtattgaagatgtgtatcagtacgttcgtgagcaatgcgacaccttcatcgggtatccgtgcaacatgcactttgattacacacctctttttccgttcctggcctatcccgtcaacaacgtgggcgatccgtttgcaagctccaactatcgcatccatacccgtgaaatcgaacgcgaggttctggcgtggttcgccgaactcatgcacattgcaccagaagaatactggggttatgtgactaatggaggatcggagggcaacctgtacggtggctttttagcgcgtgaacgctttcctgatggcgtcgcctacttctcggaagattcgcattatagcgtgtataagaatctgcgtctgctgaacatgcgtcacatcatgatcaaatcacagccgaatggtgagattgattacggcgatctctacgaaactatgcgcgctcatcgtgataagccggcaatcatctttgctaacattggtacgacgatgaccgaaggcattgacaacgtgcgcaccatccaggatatgttcaagaagctggcgattcacgaatctcatatccattgtgacgcagcattatcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatatcggtacccgcgacactacgatttcgggcagccgtaatggtattacaccgctgtttctttggtacgcggtgaaacaagctggacgcgaaggcttcaaaaagcgtgttgcggcatgtctggataacgcccgctatgccgtcgagcagtttaaacgcatcggtgtagaagcgatgcgtaatccatgtgccattaccgttgtgttcccgaaacctccgcagtcagtgctggaaaagtggcaaatcgcaaccgagggcgacattgcgcatatttgcttaatgccaagtaccacccgtcagatggtcgatgaattgatcgctgacattgcggccgccaataaagaagctgcggcaccgagcgatacggccaag

SEQ ID NO: 790 - protein, 389 aa, Artificial Sequence
  Variant of Leucine Decarboxylase from Planctomycetaceae bacterium
MGNLKFPDGALSPTDQRRIEDVYQYVREQCDTFIGYPCNMHFDYTPLFPFLAYPVNNVGDPFASSNYRIHTREIEREVLAWFAELMHIAPEEYWGYVTNGGSEGNLYGGFLARERFPDGVAYFSEDSHYSVYKNLRLLNMRHIMIKSQPNGEIDYGDLYETMRAHRDKPAIIFANIGTTMTEGIDNVRTIQDMFKKLAIHESHIHCDAALSGMTLPFMDDAPAFDFATGIDSLSISGHKFIGSPMPCGIVLTRKPYVEKIATSIEYIGTRDTTISGSRNGITPLFLWYAVKQAGREGFKKRVAACLDNARYAVEQFKRIGVEAMRNPCAITVVFPKPPQSVLEKWQIATEGDIAHICLMPSTTRQMVDELIADIAAANKEAAAPSDTAK

SEQ ID NO: 791 - DNA, 1167 bp, Artificial Sequence
  Variant of Leucine Decarboxylase from Planctomycetaceae bacterium
atgggtaatctgaaatttccagatggcgcgttgagcccgaccgaccaacgccgtattgaagatgtgtatcagtacgttcgtgagcaatgcgacaccttcatcgggtatccgtgcaacatgcactttgattacacacctctttttccgttcctggcctatcccattaacaacgtgggcgatccgtttgcaagctccaactatcgcatccatacccgtgaaatcgaacgcgaggttctggcgtggttcgccgaactcatgcacattgcaccagaagaatactggggttatgtgactaatggaggatcggagggcaacctgtacggtggctttttagcgcgtgaacgctttcctgatggcgtcgcctacttctcggaagattcgcattatagcgtgtataagaatctgcgtctgctgaacatgcgtcacatcatgatcaaatcacagccgaatggtgagattgattacggcgatctctacgaaactatgcgcgctcatcgtgataagccggcaatcatctttgctaacattggtacgacgatgaccgaaggcattgacaacgtgcgcaccatccaggatatgttcaagaagctggcgattcacgaatctcatatccattgtgacgcagcattatcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatatcggtacccgcgacactacgatttcgggcagccgtaatggtattacaccgctgtttctttggtacgcggtgaaacaagctggacgcgaaggcttcaaaaagcgtgttgcggcatgtctggataacgcccgctatgccgtcgagcagtttaaacgcatcggtgtagaagcgatgcgtaatccatgtgccattaccgttgtgttcccgaaacctccgcagtcagtgctggaaaagtggcaaatcgcaaccgagggcgacgatgcgcatatttgcttaatgccaagtaccacccgtcagatggtcgatgaattgatcgctgacattgcggccgccaataaagaagctgcggcaccgagcgatacggccaag

SEQ ID NO: 792 - protein, 389 aa, Artificial Sequence
  Variant of Leucine Decarboxylase from Planctomycetaceae bacterium
MGNLKFPDGALSPTDQRRIEDVYQYVREQCDTFIGYPCNMHFDYTPLFPFLAYPINNVGDPFASSNYRIHTREIEREVLAWFAELMHIAPEEYWGYVTNGGSEGNLYGGFLARERFPDGVAYFSEDSHYSVYKNLRLLNMRHIMIKSQPNGEIDYGDLYETMRAHRDKPAIIFANIGTTMTEGIDNVRTIQDMFKKLAIHESHIHCDAALSGMTLPFMDDAPAFDFATGIDSLSISGHKFIGSPMPCGIVLTRKPYVEKIATSIEYIGTRDTTISGSRNGITPLFLWYAVKQAGREGFKKRVAACLDNARYAVEQFKRIGVEAMRNPCAITVVFPKPPQSVLEKWQIATEGDDAHICLMPSTTRQMVDELIADIAAANKEAAAPSDTAK

SEQ ID NO: 793 - DNA, 1167 bp, Artificial Sequence
  Variant of Leucine Decarboxylase from Planctomycetaceae bacterium
atgggtaatctgaaatttccagatggcgcgttgagcccgaccgaccaacgccgtattgaagatgtgtatcagtacgttcgtgagcaatgcgacaccttcatcgggtatccgtgcaacatgcactttgattacacacctctttttccgttcctggcctatcccgtcaacaacgtgggcgatccgtttgcaaattccaactatcgcatccatacccgtgaaatcgaacgcgaggttctggcgtggttcgccgaactcatgcacattgcaccagaagaatactggggttatgtgactaatggaggatcggagggcaacctgtacggtggctttttagcgcgtgaacgctttcctgatggcgtcgcctacttctcggaagattcgcattatagcgtgtataagaatctgcgtctgctgaacatgcgtcacatcatgatcaaatcacagccgaatggtgagattgattacggcgatctctacgaaactatgcgcgctcatcgtgataagccggcaatcatctttgctaacattggtacgacgatgaccgaaggcattgacaacgtgcgcaccatccaggatatgttcaagaagctggcgattcacgaatctcatatccattgtgacgcagcattatcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatatcggtacccgcgacactacgatttcgggcagccgtaatggtattacaccgctgtttctttggtacgcggtgaaacaagctggacgcgaaggcttcaaaaagcgtgttgcggcatgtctggataacgcccgctatgccgtcgagcagtttaaacgcatcggtgtagaagcgatgcgtaatccatgtgccattaccgttgtgttcccgaaacctccgcagtcagtgctggaaaagtggcaaatcgcaaccgagggcgacgatgcgcatatttgcttaatgccaagtaccacccgtcagatggtcgatgaattgatcgctgacattgcggccgccaataaagaagctgcggcaccgagcgatacggccaag

SEQ ID NO: 794 - protein, 389 aa, Artificial Sequence
  Variant of Leucine Decarboxylase from Planctomycetaceae bacterium
MGNLKFPDGALSPTDQRRIEDVYQYVREQCDTFIGYPCNMHFDYTPLFPFLAYPVNNVGDPFANSNYRIHTREIEREVLAWFAELMHIAPEEYWGYVTNGGSEGNLYGGFLARERFPDGVAYFSEDSHYSVYKNLRLLNMRHIMIKSQPNGEIDYGDLYETMRAHRDKPAIIFANIGTTMTEGIDNVRTIQDMFKKLAIHESHIHCDAALSGMTLPFMDDAPAFDFATGIDSLSISGHKFIGSPMPCGIVLTRKPYVEKIATSIEYIGTRDTTISGSRNGITPLFLWYAVKQAGREGFKKRVAACLDNARYAVEQFKRIGVEAMRNPCAITVVFPKPPQSVLEKWQIATEGDDAHICLMPSTTRQMVDELIADIAAANKEAAAPSDTAK

SEQ ID NO: 795 - DNA, 1167 bp, Artificial Sequence
  Variant of Leucine Decarboxylase from Planctomycetaceae bacterium
atgggtaatctgaaatttccagatggcgcgttgagcccgaccgaccaacgccgtattgaagatgtgtatcagtacgttcgtgagcaatgcgacaccttcatcgggtatccgtgcaacatgcactttgattacacacctttttttccgttcctggcctatcccgtcaacaacgtgggcgatccgtttgcaagctccaactatcgcatccatacccgtgaaatcgaacgcgaggttctggcgtggttcgccgaactcatgcacattgcaccagaagaatactggggttatgtgactaatggaggatcggagggcaacctgtacggtggctttttagcgcgtgaacgctttcctgatggcgtcgcctacttctcggaagattcgcattatagcgtgtataagaatctgcgtctgctgaacatgcgtcacatcatgatcaaatcacagccgaatggtgagattgattacggcgatctctacgaaactatgcgcgctcatcgtgataagccggcaatcatctttgctaacattggtacgacgatgaccgaaggcattgacaacgtgcgcaccatccaggatatgttcaagaagctggcgattcacgaatctcatatccattgtgacgcagcattatcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatatcggtacccgcgacactacgatttcgggcagccgtaatggtattacaccgctgtttctttggtacgcggtgaaacaagctggacgcgaaggcttcaaaaagcgtgttgcggcatgtctggataacgcccgctatgccgtcgagcagtttaaacgcatcggtgtagaagcgatgcgtaatccatgtgccattaccgttgtgttcccgaaacctccgcagtcagtgctggaaaagtggcaaatcgcaaccgagggcgacgatgcgcatatttgcttaatgccaagtaccacccgtcagatggtcgatgaattgatcgctgacattgcggccgccaataaagaagctgcggcaccgagcgatacggccaag

SEQ ID NO: 796 - protein, 389 aa, Artificial Sequence
  Variant of Leucine Decarboxylase from Planctomycetaceae bacterium
MGNLKFPDGALSPTDQRRIEDVYQYVREQCDTFIGYPCNMHFDYTPFFPFLAYPVNNVGDPFASSNYRIHTREIEREVLAWFAELMHIAPEEYWGYVTNGGSEGNLYGGFLARERFPDGVAYFSEDSHYSVYKNLRLLNMRHIMIKSQPNGEIDYGDLYETMRAHRDKPAIIFANIGTTMTEGIDNVRTIQDMFKKLAIHESHIHCDAALSGMTLPFMDDAPAFDFATGIDSLSISGHKFIGSPMPCGIVLTRKPYVEKIATSIEYIGTRDTTISGSRNGITPLFLWYAVKQAGREGFKKRVAACLDNARYAVEQFKRIGVEAMRNPCAITVVFPKPPQSVLEKWQIATEGDDAHICLMPSTTRQMVDELIADIAAANKEAAAPSDTAK

SEQ ID NO: 797 - DNA, 1167 bp, Artificial Sequence
  Variant of Leucine Decarboxylase from Planctomycetaceae bacterium
atgggtaatctgaaatttccagatggcgcgttgagcccgaccgaccaacgccgtattgaagatgtgtatcagtacgttcgtgagcaatgcgacaccttcatcgggtatccgtgcaacatgcactttgattacacacctctttttccgttcgaggcctatcccgtcaacaacgtgggcgatccgtttgcaagctccaactatcgcatccatacccgtgaaatcgaacgcgaggttctggcgtggttcgccgaactcatgcacattgcaccagaagaatactggggttatgtgactaatggaggatcggagggcaacctgtacggtggctttttagcgcgtgaacgctttcctgatggcgtcgcctacttctcggaagattcgcattatagcgtgtataagaatctgcgtctgctgaacatgcgtcacatcatgatcaaatcacagccgaatggtgagattgattacggcgatctctacgaaactatgcgcgctcatcgtgataagccggcaatcatctttgctaacattggtacgacgatgaccgaaggcattgacaacgtgcgcaccatccaggatatgttcaagaagctggcgattcacgaatctcatatccattgtgacgcagcattatcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatatcggtacccgcgacactacgatttcgggcagccgtaatggtattacaccgctgtttctttggtacgcggtgaaacaagctggacgcgaaggcttcaaaaagcgtgttgcggcatgtctggataacgcccgctatgccgtcgagcagtttaaacgcatcggtgtagaagcgatgcgtaatccatgtgccattaccgttgtgttcccgaaacctccgcagtcagtgctggaaaagtggcaaatcgcaaccgagggcgacgatgcgcatatttgcttaatgccaagtaccacccgtcagatggtcgatgaattgatcgctgacattgcggccgccaataaagaagctgcggcaccgagcgatacggccaag

SEQ ID NO: 798 - protein, 389 aa, Artificial Sequence
  Variant of Leucine Decarboxylase from Planctomycetaceae bacterium
MGNLKFPDGALSPTDQRRIEDVYQYVREQCDTFIGYPCNMHFDYTPLFPFEAYPVNNVGDPFASSNYRIHTREIEREVLAWFAELMHIAPEEYWGYVTNGGSEGNLYGGFLARERFPDGVAYFSEDSHYSVYKNLRLLNMRHIMIKSQPNGEIDYGDLYETMRAHRDKPAIIFANIGTTMTEGIDNVRTIQDMFKKLAIHESHIHCDAALSGMTLPFMDDAPAFDFATGIDSLSISGHKFIGSPMPCGIVLTRKPYVEKIATSIEYIGTRDTTISGSRNGITPLFLWYAVKQAGREGFKKRVAACLDNARYAVEQFKRIGVEAMRNPCAITVVFPKPPQSVLEKWQIATEGDDAHICLMPSTTRQMVDELIADIAAANKEAAAPSDTAK

SEQ ID NO: 799 - DNA, 1167 bp, Artificial Sequence
  Variant of Leucine Decarboxylase from Planctomycetaceae bacterium
atgggtaatctgaaatttccagatggcgcgttgagcccgaccgaccaacgccgtattgaagatgtgtatcagtacgttcgtgagcaatgcgacaccttcatcgggtatccgtgcaacatgcactttgattacacacctctttttccgttcctggcctatcccgtcaacaacgtgggcgatccgtttgcaagctccaactatcgcatccatacccgtgaaatcgaacgcgaggttctggcgtggttcgccgaactcatgcacattgcaccagaagaatactggggttatgtgactaatggaggatcggagggcaacctgtacggtggctttttagcgcgtgaacgctttcctgatggcgtcgcctacttctcggaagattcgcattatagcgtgtataagaatctgcgtctgctgaacatgcgtcacatcatgatcaaatcacagccgaatggtgagattgattacggcgatctctacgaaactatgcgcgctcatcgtgataagccggcaatcatctttgctaacattggtacgacgatgaccgaaggcattgacaacgtgcgcaccatccaggatatgttcaagaagctggcgattcacgaatctcatatccattgtgacgcagcattatcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatatcggtacccgcgacactacgatttcgggcagccgtaatggtattacaccgctgtttctttggtacgcggtgaaacaagctggacgcgaaggcttcaaaaagcgtgttgcggcatgtctggataacgcccgctatgccgtcgagcagtttaaacgcatcggtgtagaagcgatgcgtaatccatgtgccattaccgttgtgttcccgaaacctccgcagtcagtgctggaaaagtggcaaatcgcaaccgagggcgaccttgcgcatatttgcttaatgccaagtaccacccgtcagatggtcgatgaattgatcgctgacattgcggccgccaataaagaagctgcggcaccgagcgatacggccaag

SEQ ID NO: 800 - protein, 389 aa, Artificial Sequence
  Variant of Leucine Decarboxylase from Planctomycetaceae bacterium
MGNLKFPDGALSPTDQRRIEDVYQYVREQCDTFIGYPCNMHFDYTPLFPFLAYPVNNVGDPFASSNYRIHTREIEREVLAWFAELMHIAPEEYWGYVTNGGSEGNLYGGFLARERFPDGVAYFSEDSHYSVYKNLRLLNMRHIMIKSQPNGEIDYGDLYETMRAHRDKPAIIFANIGTTMTEGIDNVRTIQDMFKKLAIHESHIHCDAALSGMTLPFMDDAPAFDFATGIDSLSISGHKFIGSPMPCGIVLTRKPYVEKIATSIEYIGTRDTTISGSRNGITPLFLWYAVKQAGREGFKKRVAACLDNARYAVEQFKRIGVEAMRNPCAITVVFPKPPQSVLEKWQIATEGDLAHICLMPSTTRQMVDELIADIAAANKEAAAPSDTAK

SEQ ID NO: 801 - DNA, 1167 bp, Artificial Sequence
  Variant of Leucine Decarboxylase from Planctomycetaceae bacterium
atgggtaatctgaaatttccagatggcgcgttgagcccgaccgaccaacgccgtattgaagatgtgtatcagtacgttcgtgagcaatgcgacaccttcatcgggtatccgtgcaacatgcactttgattacacacctctttttccgttccaggcctatcccgtcaacaacgtgggcgatccgtttgcaagctccaactatcgcatccatacccgtgaaatcgaacgcgaggttctggcgtggttcgccgaactcatgcacattgcaccagaagaatactggggttatgtgactaatggaggatcggagggcaacctgtacggtggctttttagcgcgtgaacgctttcctgatggcgtcgcctacttctcggaagattcgcattatagcgtgtataagaatctgcgtctgctgaacatgcgtcacatcatgatcaaatcacagccgaatggtgagattgattacggcgatctctacgaaactatgcgcgctcatcgtgataagccggcaatcatctttgctaacattggtacgacgatgaccgaaggcattgacaacgtgcgcaccatccaggatatgttcaagaagctggcgattcacgaatctcatatccattgtgacgcagcattatcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatatcggtacccgcgacactacgatttcgggcagccgtaatggtattacaccgctgtttctttggtacgcggtgaaacaagctggacgcgaaggcttcaaaaagcgtgttgcggcatgtctggataacgcccgctatgccgtcgagcagtttaaacgcatcggtgtagaagcgatgcgtaatccatgtgccattaccgttgtgttcccgaaacctccgcagtcagtgctggaaaagtggcaaatcgcaaccgagggcgacgatgcgcatatttgcttaatgccaagtaccacccgtcagatggtcgatgaattgatcgctgacattgcggccgccaataaagaagctgcggcaccgagcgatacggccaag

SEQ ID NO: 802 - protein, 389 aa, Artificial Sequence
  Variant of Leucine Decarboxylase from Planctomycetaceae bacterium
MGNLKFPDGALSPTDQRRIEDVYQYVREQCDTFIGYPCNMHFDYTPLFPFQAYPVNNVGDPFASSNYRIHTREIEREVLAWFAELMHIAPEEYWGYVTNGGSEGNLYGGFLARERFPDGVAYFSEDSHYSVYKNLRLLNMRHIMIKSQPNGEIDYGDLYETMRAHRDKPAIIFANIGTTMTEGIDNVRTIQDMFKKLAIHESHIHCDAALSGMTLPFMDDAPAFDFATGIDSLSISGHKFIGSPMPCGIVLTRKPYVEKIATSIEYIGTRDTTISGSRNGITPLFLWYAVKQAGREGFKKRVAACLDNARYAVEQFKRIGVEAMRNPCAITVVFPKPPQSVLEKWQIATEGDDAHICLMPSTTRQMVDELIADIAAANKEAAAPSDTAK

SEQ ID NO: 803 - DNA, 1167 bp, Artificial Sequence
  Variant of Leucine Decarboxylase from Planctomycetaceae bacterium
atgggtaatctgaaatttccagatggcgcgttgagcccgaccgaccaacgccgtattgaagatgtgtatcagtacgttcgtgagcaatgcgacaccttcatcgggtatccgtgcaacatgcactttgattacacacctctttttccgttcctggcctatcccgtcaacaacgtgggcgatccgtttgcaagctccaactatcgcatccatacccgtgaaatcgaacgcgaggttctggcgtggttcgccgaactcatgcacattgcaccagaagaatactggggttatgtgactaatggaggatcggagggcaacctgtacggtggctttttagcgcgtgaacgctttcctgatggcgtcgcctacttctcggaagattcgcattatagcgtgtataagaatctgcgtctgctgaacatgcgtcacatcatgatcaaatcacagccgaatggtgagattgattacggcgatctctacgaaactatgcgcgctcatcgtgataagccggcaatcatctttgctaacattggtacgacgatgaccgaaggcattgacaacgtgcgcaccatccaggatatgttcaagaagctggcgattcacgaatctcatatccattgtgacgcagcattatcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatatcggtacccgcgacactacgatttcgggcagccgtaatggtattacaccgctgtttctttggtacgcggtgaaacaagctggacgcgaaggcttcaaaaagcgtgttgcggcatgtctggataacgcccgctatgccgtcgagcagtttaaacgcatcggtgtagaagcgatgcgtaatccatgtgccattaccgttgtgttcccgaaacctccgcagtcagtgctggaaaagtggcaaatcgcaaccgagggcgacgatgcgcatatttgcttaatgccaagtaccacccgtcagatggtcgatgaattgatcgctgacattgcggccgccaataaagaagctgcggcatggagcgatacggccaag

SEQ ID NO: 804 - protein, 389 aa, Artificial Sequence
  Variant of Leucine Decarboxylase from Planctomycetaceae bacterium
MGNLKFPDGALSPTDQRRIEDVYQYVREQCDTFIGYPCNMHFDYTPLFPFLAYPVNNVGDPFASSNYRIHTREIEREVLAWFAELMHIAPEEYWGYVTNGGSEGNLYGGFLARERFPDGVAYFSEDSHYSVYKNLRLLNMRHIMIKSQPNGEIDYGDLYETMRAHRDKPAIIFANIGTTMTEGIDNVRTIQDMFKKLAIHESHIHCDAALSGMTLPFMDDAPAFDFATGIDSLSISGHKFIGSPMPCGIVLTRKPYVEKIATSIEYIGTRDTTISGSRNGITPLFLWYAVKQAGREGFKKRVAACLDNARYAVEQFKRIGVEAMRNPCAITVVFPKPPQSVLEKWQIATEGDDAHICLMPSTTRQMVDELIADIAAANKEAAAWSDTAK

SEQ ID NO: 805 - DNA, 1167 bp, Artificial Sequence
  Variant of Leucine Decarboxylase from Planctomycetaceae bacterium
atgggtaatctgaaatttccagatggcgcgttgagcccgaccgaccaacgccgtattgaagatgtgtatcagtacgttcgtgagcaatgcgacaccttcatcgggtatccgtgcaacatgcactttgattacacacctctttttccgttcctggcctatcccgtcaacaacgtgggcgatccgtttgcaagctccaactatcgcatccatacccgtgaaatcgaacgcgaggttctggcgtggttcgccgaactcatgcacattgcaccagaagaatactggggttatgtgactaatggaggatcggagggcaacctgtacggtggctttttagcgcgtgaacgctttcctgatggcgtcgcctacttctcggaagattcgcattatagcgtgtataagaatctgcgtctgctgaacatgcgtcacatcatgatcaaatcacagccgaatggtgagattgattacggcgatctctacgaaactatgcgcgctcatcgtgataagccggcaatcatctttgctaacattggtacgacgatgaccgaaggcattgacaacgtgcgcaccatccaggatatgttcaagaagctggcgattcacgaatctcatatccattgtgacgcagcattatcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatatcggtacccgcgacactacgatttcgggcagccgtaatggtattacaccgctgtttctttggtacgcggtgaaacaagctggacgcgaaggcttcaaaaagcgtgttgcggcatgtctggataacgcccgctatgccgtcgagcagtttaaacgcatcggtgtagaagcgatgcgtaatccatgtgccattaccgttgtgttcccgaaacctccgcagtcagtgctggaaaagtggcaaatcgcaaccgagggcgacgatgcgcatatttcgttaatgccaagtaccacccgtcagatggtcgatgaattgatcgctgacattgcggccgccaataaagaagctgcggcaccgagcgatacggccaag

SEQ ID NO: 806 - protein, 389 aa, Artificial Sequence
  Variant of Leucine Decarboxylase from Planctomycetaceae bacterium
MGNLKFPDGALSPTDQRRIEDVYQYVREQCDTFIGYPCNMHFDYTPLFPFLAYPVNNVGDPFASSNYRIHTREIEREVLAWFAELMHIAPEEYWGYVTNGGSEGNLYGGFLARERFPDGVAYFSEDSHYSVYKNLRLLNMRHIMIKSQPNGEIDYGDLYETMRAHRDKPAIIFANIGTTMTEGIDNVRTIQDMFKKLAIHESHIHCDAALSGMTLPFMDDAPAFDFATGIDSLSISGHKFIGSPMPCGIVLTRKPYVEKIATSIEYIGTRDTTISGSRNGITPLFLWYAVKQAGREGFKKRVAACLDNARYAVEQFKRIGVEAMRNPCAITVVFPKPPQSVLEKWQIATEGDDAHISLMPSTTRQMVDELIADIAAANKEAAAPSDTAK

SEQ ID NO: 807 - DNA, 1167 bp, Artificial Sequence
  Variant of Leucine Decarboxylase from Planctomycetaceae bacterium
atgggtaatctgaaatttccagatggcgcgttgagcccgaccgaccaacgccgtattgaagatgtgtatcagtacgttcgtgagcaatgcgacaccttcatcgggtatccgtgcaacatgcactttgattacacacctctttttccgttcctggcctatcccgtcaacaacgtgggcgatccgtttgcaagctccaactatcgcatccatacccgtgaaatcgaacgcgaggttctggcgtggttcgccgaactcatgcacattgcaccagaagaatactggggttatgtgactaatggaggatcggagggcaacctgtacggtggctttttagcgcgtgaacgctttcctgatggcgtcgcctacttctcggaagattcgcattatagcgtgtataagaatctgcgtctgctgaacatgcgtcacatcatgatcaaatcacagccgaatggtgagattgattacggcgatctctacgaaactatgcgcgctcatcgtgataagccggcaatcatctttgctaacattggtacgacgatgaccgaaggcattgacaacgtgcgcaccatccaggatatgttcaagaagctggcgattcacgaatctcatatccattgtgacgcagcattatcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatttgggtacccgcgacactacgatttcgggcagccgtaatggtattacaccgctgtttctttggtacgcggtgaaacaagctggacgcgaaggcttcaaaaagcgtgttgcggcatgtctggataacgcccgctatgccgtcgagcagtttaaacgcatcggtgtagaagcgatgcgtaatccatgtgccattaccgttgtgttcccgaaacctccgcagtcagtgctggaaaagtggcaaatcgcaaccgagggcgacgatgcgcatatttgcttaatgccaagtaccacccgtcagatggtcgatgaattgatcgctgacattgcggccgccaataaagaagctgcggcaccgagcgatacggccaag

SEQ ID NO: 808 - protein, 389 aa, Artificial Sequence
  Variant of Leucine Decarboxylase from Planctomycetaceae bacterium
MGNLKFPDGALSPTDQRRIEDVYQYVREQCDTFIGYPCNMHFDYTPLFPFLAYPVNNVGDPFASSNYRIHTREIEREVLAWFAELMHIAPEEYWGYVTNGGSEGNLYGGFLARERFPDGVAYFSEDSHYSVYKNLRLLNMRHIMIKSQPNGEIDYGDLYETMRAHRDKPAIIFANIGTTMTEGIDNVRTIQDMFKKLAIHESHIHCDAALSGMTLPFMDDAPAFDFATGIDSLSISGHKFIGSPMPCGIVLTRKPYVEKIATSIEYLGTRDTTISGSRNGITPLFLWYAVKQAGREGFKKRVAACLDNARYAVEQFKRIGVEAMRNPCAITVVFPKPPQSVLEKWQIATEGDDAHICLMPSTTRQMVDELIADIAAANKEAAAPSDTAK

SEQ ID NO: 809 - DNA, 1167 bp, Artificial Sequence
  Variant of Leucine Decarboxylase from Planctomycetaceae bacterium
atgggtaatctgaaatttccagatggcgcgttgagcccgaccgaccaacgccgtattgaagatgtgtatcagtacgttcgtgagcaatgcgacaccttcatcgggtatccgtgcaacatgcactttgattacacacctctttttccgttcctggcctatcccgtcaacaacgtgggcgatccgtttgcaagctccaactatcgcatccatacccgtgaaatcgaacgcgaggttctggcgtggttcgccgaactcatgcacattgcaccagaagaatactggggttatgtgactaatggaggatcggagggcaacctgtacggtggctttttagcgcgtgaacgctttcctgatggcgtcgcctacttctcggaagcttcgcattatagcgtgtataagaatctgcgtctgctgaacatgcgtcacatcatgatcaaatcacagccgaatggtgagattgattacggcgatctctacgaaactatgcgcgctcatcgtgataagccggcaatcatctttgctaacattggtacgacgatgaccgaaggcattgacaacgtgcgcaccatccaggatatgttcaagaagctggcgattcacgaatctcatatccattgtgacgcagcattatcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatatcggtacccgcgacactacgatttcgggcagccgtaatggtattacaccgctgtttctttggtacgcggtgaaacaagctggacgcgaaggcttcaaaaagcgtgttgcggcatgtctggataacgcccgctatgccgtcgagcagtttaaacgcatcggtgtagaagcgatgcgtaatccatgtgccattaccgttgtgttcccgaaacctccgcagtcagtgctggaaaagtggcaaatcgcaaccgagggcgacgatgcgcatatttgcttaatgccaagtaccacccgtcagatggtcgatgaattgatcgctgacattgcggccgccaataaagaagctgcggcaccgagcgatacggccaag

SEQ ID NO: 810 - protein, 389 aa, Artificial Sequence
  Variant of Leucine Decarboxylase from Planctomycetaceae bacterium
MGNLKFPDGALSPTDQRRIEDVYQYVREQCDTFIGYPCNMHFDYTPLFPFLAYPVNNVGDPFASSNYRIHTREIEREVLAWFAELMHIAPEEYWGYVTNGGSEGNLYGGFLARERFPDGVAYFSEASHYSVYKNLRLLNMRHIMIKSQPNGEIDYGDLYETMRAHRDKPAIIFANIGTTMTEGIDNVRTIQDMFKKLAIHESHIHCDAALSGMTLPFMDDAPAFDFATGIDSLSISGHKFIGSPMPCGIVLTRKPYVEKIATSIEYIGTRDTTISGSRNGITPLFLWYAVKQAGREGFKKRVAACLDNARYAVEQFKRIGVEAMRNPCAITVVFPKPPQSVLEKWQIATEGDDAHICLMPSTTRQMVDELIADIAAANKEAAAPSDTAK

SEQ ID NO: 811 - DNA, 1167 bp, Artificial Sequence
  Variant of Leucine Decarboxylase from Planctomycetaceae bacterium
atgggtaatctgaaatttccagatggcgcgttgagcccgaccgaccaacgccgtattgaagatgtgtatcagtacgttcgtgagcaatgcgacacccttatcgggtatccgtgcaacatgcactttgattacacacctctttttccgttcctggcctatcccgtcaacaacgtgggcgatccgtttgcaagctccaactatcgcatccatacccgtgaaatcgaacgcgaggttctggcgtggttcgccgaactcatgcacattgcaccagaagaatactggggttatgtgactaatggaggatcggagggcaacctgtacggtggctttttagcgcgtgaacgctttcctgatggcgtcgcctacttctcggaagattcgcattatagcgtgtataagaatctgcgtctgctgaacatgcgtcacatcatgatcaaatcacagccgaatggtgagattgattacggcgatctctacgaaactatgcgcgctcatcgtgataagccggcaatcatctttgctaacattggtacgacgatgaccgaaggcattgacaacgtgcgcaccatccaggatatgttcaagaagctggcgattcacgaatctcatatccattgtgacgcagcattatcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatatcggtacccgcgacactacgatttcgggcagccgtaatggtattacaccgctgtttctttggtacgcggtgaaacaagctggacgcgaaggcttcaaaaagcgtgttgcggcatgtctggataacgcccgctatgccgtcgagcagtttaaacgcatcggtgtagaagcgatgcgtaatccatgtgccattaccgttgtgttcccgaaacctccgcagtcagtgctggaaaagtggcaaatcgcaaccgagggcgacgatgcgcatatttgcttaatgccaagtaccacccgtcagatggtcgatgaattgatcgctgacattgcggccgccaataaagaagctgcggcaccgagcgatacggccaag

SEQ ID NO: 812 - protein, 389 aa, Artificial Sequence
  Variant of Leucine Decarboxylase from Planctomycetaceae bacterium
MGNLKFPDGALSPTDQRRIEDVYQYVREQCDTLIGYPCNMHFDYTPLFPFLAYPVNNVGDPFASSNYRIHTREIEREVLAWFAELMHIAPEEYWGYVTNGGSEGNLYGGFLARERFPDGVAYFSEDSHYSVYKNLRLLNMRHIMIKSQPNGEIDYGDLYETMRAHRDKPAIIFANIGTTMTEGIDNVRTIQDMFKKLAIHESHIHCDAALSGMTLPFMDDAPAFDFATGIDSLSISGHKFIGSPMPCGIVLTRKPYVEKIATSIEYIGTRDTTISGSRNGITPLFLWYAVKQAGREGFKKRVAACLDNARYAVEQFKRIGVEAMRNPCAITVVFPKPPQSVLEKWQIATEGDDAHICLMPSTTRQMVDELIADIAAANKEAAAPSDTAK

SEQ ID NO: 813 - DNA, 1167 bp, Artificial Sequence
  Variant of Leucine Decarboxylase from Planctomycetaceae bacterium
atgggtaatctgaaatttccagatggcgcgttgagcccgaccgaccaacgccgtattgaagatgtgtatcagtacgttcgtgagcaatgcgacaccttcatcgggtatccgtgcaacatgcactttgattacacacctctttttccgttcctggcctatcccgtcaacaacgtgggcgatccgtttgcaagctccaactatcgcatccatacccgtgaaatcgaacgcgaggttctggcgtggttcgccgaactcatgcacattgcaccagaagaatactggggttatgtgactaatggaggatcggagggcaacctgtacggtggctttttagcgcgtgaacgctttcctgatggcgtcgcctacttctcggaaacttcgcattatagcgtgtataagaatctgcgtctgctgaacatgcgtcacatcatgatcaaatcacagccgaatggtgagattgattacggcgatctctacgaaactatgcgcgctcatcgtgataagccggcaatcatctttgctaacattggtacgacgatgaccgaaggcattgacaacgtgcgcaccatccaggatatgttcaagaagctggcgattcacgaatctcatatccattgtgacgcagcattatcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatatcggtacccgcgacactacgatttcgggcagccgtaatggtattacaccgctgtttctttggtacgcggtgaaacaagctggacgcgaaggcttcaaaaagcgtgttgcggcatgtctggataacgcccgctatgccgtcgagcagtttaaacgcatcggtgtagaagcgatgcgtaatccatgtgccattaccgttgtgttcccgaaacctccgcagtcagtgctggaaaagtggcaaatcgcaaccgagggcgacgatgcgcatatttgcttaatgccaagtaccacccgtcagatggtcgatgaattgatcgctgacattgcggccgccaataaagaagctgcggcaccgagcgatacggccaag

SEQ ID NO: 814 - protein, 389 aa, Artificial Sequence
  Variant of Leucine Decarboxylase from Planctomycetaceae bacterium
MGNLKFPDGALSPTDQRRIEDVYQYVREQCDTFIGYPCNMHFDYTPLFPFLAYPVNNVGDPFASSNYRIHTREIEREVLAWFAELMHIAPEEYWGYVTNGGSEGNLYGGFLARERFPDGVAYFSETSHYSVYKNLRLLNMRHIMIKSQPNGEIDYGDLYETMRAHRDKPAIIFANIGTTMTEGIDNVRTIQDMFKKLAIHESHIHCDAALSGMTLPFMDDAPAFDFATGIDSLSISGHKFIGSPMPCGIVLTRKPYVEKIATSIEYIGTRDTTISGSRNGITPLFLWYAVKQAGREGFKKRVAACLDNARYAVEQFKRIGVEAMRNPCAITVVFPKPPQSVLEKWQIATEGDDAHICLMPSTTRQMVDELIADIAAANKEAAAPSDTAK

SEQ ID NO: 815 - DNA, 1167 bp, Artificial Sequence
  Variant of Leucine Decarboxylase from Planctomycetaceae bacterium
atgggtaatctgaaatttccagatggcgcgttgagcccgaccgaccaacgccgtattgaagatgtgtatcagtacgttcgtgagcaatgcgacaccttcatcgggtatccgtgcaacatgcactttgattacacacctctttttccgttcctggcctatcccgtcaacaacgtgggcgatccgtttgcaagctccaactatcgcatccatacccgtgaaatcgaacgcgaggttctggcgtggttcgccgaactcatgcacattgcaccagaagaatactggggttatgtgactaatggaggatcggagggcaacctgtacggtggctttttagcgcgtgaacgctttcctgatggcgtcgcctacttctcggaagattcgcattatagcgtgtataagaatctgcgtctgctgaacatgcgtcacatcatgatcaaatcacagccgaatggtgagattgattacggcgatctctacgaaactatgcgcgctcatcgtgataagccggcaatcatctttgctaacattggtacgacgatgaccgaaggcattgacaacgtgcgcaccatccaggatatgttcaagaagctggcgattcacgaatctcatatccattgtgacgcagcattatcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatatcggtaccacggacactacgatttcgggcagccgtaatggtattacaccgctgtttctttggtacgcggtgaaacaagctggacgcgaaggcttcaaaaagcgtgttgcggcatgtctggataacgcccgctatgccgtcgagcagtttaaacgcatcggtgtagaagcgatgcgtaatccatgtgccattaccgttgtgttcccgaaacctccgcagtcagtgctggaaaagtggcaaatcgcaaccgagggcgacgatgcgcatatttgcttaatgccaagtaccacccgtcagatggtcgatgaattgatcgctgacattgcggccgccaataaagaagctgcggcaccgagcgatacggccaag

SEQ ID NO: 816 - protein, 389 aa, Artificial Sequence
  Variant of Leucine Decarboxylase from Planctomycetaceae bacterium
MGNLKFPDGALSPTDQRRIEDVYQYVREQCDTFIGYPCNMHFDYTPLFPFLAYPVNNVGDPFASSNYRIHTREIEREVLAWFAELMHIAPEEYWGYVTNGGSEGNLYGGFLARERFPDGVAYFSEDSHYSVYKNLRLLNMRHIMIKSQPNGEIDYGDLYETMRAHRDKPAIIFANIGTTMTEGIDNVRTIQDMFKKLAIHESHIHCDAALSGMTLPFMDDAPAFDFATGIDSLSISGHKFIGSPMPCGIVLTRKPYVEKIATSIEYIGTTDTTISGSRNGITPLFLWYAVKQAGREGFKKRVAACLDNARYAVEQFKRIGVEAMRNPCAITVVFPKPPQSVLEKWQIATEGDDAHICLMPSTTRQMVDELIADIAAANKEAAAPSDTAK

SEQ ID NO: 817 - DNA, 1167 bp, Artificial Sequence
  Variant of Leucine Decarboxylase from Planctomycetaceae bacterium
atgggtaatctgaaatttccagatggcgcgttgagcccgaccgaccaacgccgtattgaagatgtgtatcagtacgttcgtgagcaatgcgacaccttcatcgggtatccgtgcaacatgcactttgattacacacctctttttccgttcctggcctatcccgtcaacaacgtgggcgatccgtttgcaagctccaactatcgcatccatacccgtgaaatcgaacgcgaggttctggcgtggttcgccgaactcatgcacattgcaccagaagaatactggggttatgtgactaatggaggatcggagggcaacctgtacggtggctttttagcgcgtgaacgctttcctgatggcgtcgcctacttctcggaagattcgcattatagcgtgtataagaatctgcgtctgctgaacatgcgtcacatcatgatcaaatcacagccgaatggtgagattgattacggcgatctctacgaaactatgcgcgctcatcgtgataagccggcaatcatctttgctaacattggtacgacgatgaccgaaggcattgacaacgtgcgcaccatccaggatatgttcaagaagctggcgattcacgaatctcatatccattgtgacgcagcattatcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatatcggtaccgctgacactacgatttcgggcagccgtaatggtattacaccgctgtttctttggtacgcggtgaaacaagctggacgcgaaggcttcaaaaagcgtgttgcggcatgtctggataacgcccgctatgccgtcgagcagtttaaacgcatcggtgtagaagcgatgcgtaatccatgtgccattaccgttgtgttcccgaaacctccgcagtcagtgctggaaaagtggcaaatcgcaaccgagggcgacgatgcgcatatttgcttaatgccaagtaccacccgtcagatggtcgatgaattgatcgctgacattgcggccgccaataaagaagctgcggcaccgagcgatacggccaag

SEQ ID NO: 818 - protein, 389 aa, Artificial Sequence
  Variant of Leucine Decarboxylase from Planctomycetaceae bacterium
MGNLKFPDGALSPTDQRRIEDVYQYVREQCDTFIGYPCNMHFDYTPLFPFLAYPVNNVGDPFASSNYRIHTREIEREVLAWFAELMHIAPEEYWGYVTNGGSEGNLYGGFLARERFPDGVAYFSEDSHYSVYKNLRLLNMRHIMIKSQPNGEIDYGDLYETMRAHRDKPAIIFANIGTTMTEGIDNVRTIQDMFKKLAIHESHIHCDAALSGMTLPFMDDAPAFDFATGIDSLSISGHKFIGSPMPCGIVLTRKPYVEKIATSIEYIGTADTTISGSRNGITPLFLWYAVKQAGREGFKKRVAACLDNARYAVEQFKRIGVEAMRNPCAITVVFPKPPQSVLEKWQIATEGDDAHICLMPSTTRQMVDELIADIAAANKEAAAPSDTAK

SEQ ID NO: 819 - DNA, 1167 bp, Artificial Sequence
  Variant of Leucine Decarboxylase from Planctomycetaceae bacterium
atgggtaatctgaaatttccagatggcgcgttgagcccgaccgaccaacgccgtattgaagatgtgtatcagtacgttcgtgagcaatgcgacaccttcatcgggtatccgtgcaacatgcactttgattacacacctctttttccgttcctggcctatcccgtcaacaacgtgggcgatccgtttgcaagctccaactatcgcatccatacccgtgaaatcgaacgcgaggttctggcgtggttcgccgaactcatgcacattgcaccagaagaatactggggttatgtgactaatggaggatcggagggcaacctgtacggtggctttttagcgcgtgaacgctttcctgatggcgtcgcctacttctcggaagattcgcattatagcgtgtataagaatctgcgtctgctgaacatgcgtcacatcatgatcaaatcacagccgaatggtgagattgattacggcgatctctacgaaactatgcgcgctcatcgtgataagccggcaatcatctttgctaacattggtacgacgatgaccgaaggcattgacaacgtgcgcaccatccaggatatgttcaagaagctggcgattcacgaatctcatatccattgtgacgcagcattatcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattccgtatatcggtacccgcgacactacgatttcgggcagccgtaatggtattacaccgctgtttctttggtacgcggtgaaacaagctggacgcgaaggcttcaaaaagcgtgttgcggcatgtctggataacgcccgctatgccgtcgagcagtttaaacgcatcggtgtagaagcgatgcgtaatccatgtgccattaccgttgtgttcccgaaacctccgcagtcagtgctggaaaagtggcaaatcgcaaccgagggcgacgatgcgcatatttgcttaatgccaagtaccacccgtcagatggtcgatgaattgatcgctgacattgcggccgccaataaagaagctgcggcaccgagcgatacggccaag

SEQ ID NO: 820 - protein, 389 aa, Artificial Sequence
  Variant of Leucine Decarboxylase from Planctomycetaceae bacterium
MGNLKFPDGALSPTDQRRIEDVYQYVREQCDTFIGYPCNMHFDYTPLFPFLAYPVNNVGDPFASSNYRIHTREIEREVLAWFAELMHIAPEEYWGYVTNGGSEGNLYGGFLARERFPDGVAYFSEDSHYSVYKNLRLLNMRHIMIKSQPNGEIDYGDLYETMRAHRDKPAIIFANIGTTMTEGIDNVRTIQDMFKKLAIHESHIHCDAALSGMTLPFMDDAPAFDFATGIDSLSISGHKFIGSPMPCGIVLTRKPYVEKIATSIPYIGTRDTTISGSRNGITPLFLWYAVKQAGREGFKKRVAACLDNARYAVEQFKRIGVEAMRNPCAITVVFPKPPQSVLEKWQIATEGDDAHICLMPSTTRQMVDELIADIAAANKEAAAPSDTAK

SEQ ID NO: 821 - DNA, 1167 bp, Artificial Sequence
  Variant of Leucine Decarboxylase from Planctomycetaceae bacterium
atgggtaatctgaaatttccagatggcgcgttgagcccgaccgaccaacgccgtattgaagatgtgtatcagtacgttcgtgagcaatgcgacaccttcatcgggtatccgtgcaacatgcactttgattacacacctctttttccgttcctggcctatcccgtcaacaacgtgggcgatccgtttgcaagctccaactatcgcatccatacccgtgaaatcgaacgcgaggttctggcgtggttcgccgaactcatgcacattgcaccagaagaatactggggttatgtgactaatggaggatcggagggcaacctgtacggtggctttttagcgcgtgaacgctttcctgatggcgtcgcctacttctcggaagattcgcattatagcgtgtataagaatctgcgtctgctgaacatgcgtcacatcatgatcaaatcacagccgaatggtgagattgattacggcgatctctacgaaactatgcgcgctcatcgtgataagccggcaatcatctttgctaacattggtacgacgatgaccgaaggcattgacaacgtgcgcaccatccaggatatgttcaagaagctggcgattcacgaatctcatatccattgtgacgcagcattatcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatatcggtacccgcgacactacgatttcgggcagccgtaatggtattacaccgctgtttctttggtacgcggtgaaacaagctggacgcgaaggcttcaaaaagcgtgttgcggcatgtctggataacgcccgctatgccgtcgagcagtttaaacgcatcggtgtagaagcgatgcgtaatccatgtgccattaccgttgtgttcccgaaacctccgcagtcagtgctggaaaagtggcaaatcgcaaccgagggcgacgaggcgcatatttgcttaatgccaagtaccacccgtcagatggtcgatgaattgatcgctgacattgcggccgccaataaagaagctgcggcaccgagcgatacggccaag

SEQ ID NO: 822 - protein, 389 aa, Artificial Sequence
  Variant of Leucine Decarboxylase from Planctomycetaceae bacterium
MGNLKFPDGALSPTDQRRIEDVYQYVREQCDTFIGYPCNMHFDYTPLFPFLAYPVNNVGDPFASSNYRIHTREIEREVLAWFAELMHIAPEEYWGYVTNGGSEGNLYGGFLARERFPDGVAYFSEDSHYSVYKNLRLLNMRHIMIKSQPNGEIDYGDLYETMRAHRDKPAIIFANIGTTMTEGIDNVRTIQDMFKKLAIHESHIHCDAALSGMTLPFMDDAPAFDFATGIDSLSISGHKFIGSPMPCGIVLTRKPYVEKIATSIEYIGTRDTTISGSRNGITPLFLWYAVKQAGREGFKKRVAACLDNARYAVEQFKRIGVEAMRNPCAITVVFPKPPQSVLEKWQIATEGDEAHICLMPSTTRQMVDELIADIAAANKEAAAPSDTAK

SEQ ID NO: 823 - DNA, 1167 bp, Artificial Sequence
  Variant of Leucine Decarboxylase from Planctomycetaceae bacterium
atgggtaatctgaaatttccagatggcgcgttgagcccgaccgaccaacgccgtattgaagatgtgtatcagtacgttcgtgagcaatgcgacaccttcatcgggtatccgtgcaacatgcactttgattacacacctctttttccgttcctggcctatcccgtcaacaacgtgggcgatccgtttgcaagctccaattatcgcatccatacccgtgaaatcgaacgcgaggttctggcgtggttcgccgaactcatgcacattgcaccagaagaatactggggttatgtgactaatggaggatcggagggcaacctgtacggtggctttttagcgcgtgaacgctttcctactggcgtcgcctacttctcggaagattcgcattatagcgtgtataagaatctgcgtctgctgaacatgcgtcacatcatgatcaaatcacagccgaatggtgagattgattacggcgatctctacgaaactatgcgcgctcatcgtgataagccggcaatcatctttgctaacattggtacgacgatgaccgaaggcattgacaacgtgcgcaccatccaggatatgttcaagaagctggcgattcacgaatctcatatccattgtgacgcagcattatcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatatcggtacccgcgacactacgatttcgggcagccgtaatggtattacaccgctgtttctttggtacgcggtgaaacaagctggacgcgagggcttcaaacgccgtgttgcggcatgtctggataacgcccgctatgccgtcgagcagtttaaacgcatcggtgtagaagcgatgcgtaatccatgtgccattaccgttgtgttcccgaaacctccgcagtcagtgctggaaaagtggcaaatcgcaaccgagggcgacgatgcgcatatttgcttaatgccaagtaccacccgtcagatggtcgatgaattgatcgctgacattgcggccgccaataaagaagctgcggcaccgagcgatacggccaag

SEQ ID NO: 824 - protein, 389 aa, Artificial Sequence
  Variant of Leucine Decarboxylase from Planctomycetaceae bacterium
MGNLKFPDGALSPTDQRRIEDVYQYVREQCDTFIGYPCNMHFDYTPLFPFLAYPVNNVGDPFASSNYRIHTREIEREVLAWFAELMHIAPEEYWGYVTNGGSEGNLYGGFLARERFPTGVAYFSEDSHYSVYKNLRLLNMRHIMIKSQPNGEIDYGDLYETMRAHRDKPAIIFANIGTTMTEGIDNVRTIQDMFKKLAIHESHIHCDAALSGMTLPFMDDAPAFDFATGIDSLSISGHKFIGSPMPCGIVLTRKPYVEKIATSIEYIGTRDTTISGSRNGITPLFLWYAVKQAGREGFKRRVAACLDNARYAVEQFKRIGVEAMRNPCAITVVFPKPPQSVLEKWQIATEGDDAHICLMPSTTRQMVDELIADIAAANKEAAAPSDTAK

SEQ ID NO: 825 - DNA, 1167 bp, Artificial Sequence
  Variant of Leucine Decarboxylase from Planctomycetaceae bacterium
atgggtaatctgaaatttccagatggcgcgttgagcccgaccgaccaacgccgtattgaagatgtgtatcagtacgttcgtgagcaatgcgacaccttcatcgggtatccgtgcaacatgcactttgattacacacctctttttccgttcctggcctatcccgtcaacaacgtgggcgatccgtttgcaagctccaattatcgcatccatacccgtgaaatcgaacgcgaggttctggcgtggttcgccgaactcatgcacattgcaccagaagaatactggggttatgtgactaatggaggatcggagggcaacctgtacggtggctttttagcgcgtgaacgctttcctactggcgtcgcctacttctcggaagattcgcattatagcgtgtataagaatctgcgtctgctgaacatgcgtcacatcatgatcaaatcacagccgaatggtgagattgattacggcgatctctacgaaactatgcgcgctcatcgtgataagccggcaatcatctttgctaacattggtacgacgatgaccgaaggcattgacaacgtgcgcaccatccaggatatgttcaagaagctggcgattcacgaatctcatatccattgtgacgcagcattatcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatatcggtacccgcgacactacgatttcgggcagccgtaatggtattacaccgctgtttctttggtacgcggtgaaacaagctggacgcgagggcttcaaaaagcgtgttgcggcatgtctggataacgcccgctatgccgtcgagcagtttaaacgcatcggtgtagaagcgatgcgtaatccatgtgccattaccgttgtgttcccgaaacctccgcagtcagtgctggaaaagtggcaaatcgcaaccgagggcgacgatgcgcatatttgcttaatgccaagtaccacccgtcagatggtcgatgaattgatcgctgacattgcggccgccaataaagaagctgcggcaccgagcgatacggccaag

SEQ ID NO: 826 - protein, 389 aa, Artificial Sequence
  Variant of Leucine Decarboxylase from Planctomycetaceae bacterium
MGNLKFPDGALSPTDQRRIEDVYQYVREQCDTFIGYPCNMHFDYTPLFPFLAYPVNNVGDPFASSNYRIHTREIEREVLAWFAELMHIAPEEYWGYVTNGGSEGNLYGGFLARERFPTGVAYFSEDSHYSVYKNLRLLNMRHIMIKSQPNGEIDYGDLYETMRAHRDKPAIIFANIGTTMTEGIDNVRTIQDMFKKLAIHESHIHCDAALSGMTLPFMDDAPAFDFATGIDSLSISGHKFIGSPMPCGIVLTRKPYVEKIATSIEYIGTRDTTISGSRNGITPLFLWYAVKQAGREGFKKRVAACLDNARYAVEQFKRIGVEAMRNPCAITVVFPKPPQSVLEKWQIATEGDDAHICLMPSTTRQMVDELIADIAAANKEAAAPSDTAK

SEQ ID NO: 827 - DNA, 1167 bp, Artificial Sequence
  Variant of Leucine Decarboxylase from Planctomycetaceae bacterium
atgggtaatctgaaatttccagatggcgcgttgagcccgaccgaccaacgccgtattgaagatgtgtatcagtacgttcgtgagcaatgcgacaccttcatcgggtatccgtgcaacatgcactttgattacacacctctttttccgttcctggcctatcccgtcaacaacgtgggcgatccgtttgcaagctccagttatcgcatccatacccgtgaaatcgaacgcgaggttctggcgtggttcgccgaactcatgcacattgcaccagaagaatactggggttatgtgactaatggaggatcggagggcaacctgtacggtggctttttagcgcgtgaacgctttcctgacggcgtcgcctacttctcggaagattcgcattatagcgtgtataagaatctgcgtctgctgaacatgcgtcacatcatgatcaaatcacagccgaatggtgagattgattacggcgatctctacgaaactatgcgcgctcatcgtgataagccggcaatcatctttgctaacattggtacgacgatgaccgaaggcattgacaacgtgcgcaccatccaggatatgttcaagaagctggcgattcacgaatctcatatccattgtgacgcagcattatcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatatcggtacccgcgacactacgatttcgggcagccgtaatggtattacaccgctgtttctttggtacgcggtgaaacaagctggacgcgagggcttcaaaaagcgtgttgcggcatgtctggataacgcccgctatgccgtcgagcagtttaaacgcatcggtgtagaagcgatgcgtaatccatgtgccattaccgttgtgttcccgaaacctccgcagtcagtgctggaaaagtggcaaatcgcaaccgagggcgacgatgcgcatatttgcttaatgccaagtaccacccgtcagatggtcgatgaattgatcgctgacattgcggccgccaataaagaagctgcggcaccgagcgatacggccaag

SEQ ID NO: 828 - protein, 389 aa, Artificial Sequence
  Variant of Leucine Decarboxylase from Planctomycetaceae bacterium
MGNLKFPDGALSPTDQRRIEDVYQYVREQCDTFIGYPCNMHFDYTPLFPFLAYPVNNVGDPFASSSYRIHTREIEREVLAWFAELMHIAPEEYWGYVTNGGSEGNLYGGFLARERFPDGVAYFSEDSHYSVYKNLRLLNMRHIMIKSQPNGEIDYGDLYETMRAHRDKPAIIFANIGTTMTEGIDNVRTIQDMFKKLAIHESHIHCDAALSGMTLPFMDDAPAFDFATGIDSLSISGHKFIGSPMPCGIVLTRKPYVEKIATSIEYIGTRDTTISGSRNGITPLFLWYAVKQAGREGFKKRVAACLDNARYAVEQFKRIGVEAMRNPCAITVVFPKPPQSVLEKWQIATEGDDAHICLMPSTTRQMVDELIADIAAANKEAAAPSDTAK

SEQ ID NO: 829 - DNA, 1167 bp, Artificial Sequence
  Variant of Leucine Decarboxylase from Planctomycetaceae bacterium
atgggtaatctgaaatttccagatggcgcgttgagcccgaccgaccaacgccgtattgaagatgtgtatcagtacgttcgtgagcaatgcgacaccttcatcgggtatccgtgcaacatgcactttgattacacacctctttttccgttcctggcctatcccgtcaacaacgtgggcgatccgtttgcaagctccaattatcgcatccatacccgtgaaatcgaacgcgaggttctggcgtggttcgccgaactcatgcacattgcaccagaagaatactggggttatgtgactaatggaggatcggagggcaacctgtacggtggctttttagcgcgtgaacgctttcctgacggcgtcgcctacttctcggaagattcgcattatagcgtgtataagaatctgcgtctgctgaacatgcgtcacatcatgatcaaatcacagccgaatggtgagattgattacggcgatctctacgaaactatgcgcgctcatcgtgataagccggcaatcatctttgctaacattggtacgacgatgaccgaaggcattgacaacgtgcgcaccatccaggatatgttcaagaagctggcgattcacgaatctcatatccattgtgacgcagcattatcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatatcggtacccgcgacactacgatttcgggcagccgtaatggtattacaccgctgtttctttggtacgcggtgaaacaagctggacgcgacggcttcaaaaagcgtgttgcggcatgtctggataacgcccgctatgccgtcgagcagtttaaacgcatcggtgtagaagcgatgcgtaatccatgtgccattaccgttgtgttcccgaaacctccgcagtcagtgctggaaaagtggcaaatcgcaaccgagggcgacgatgcgcatatttgcttaatgccaagtaccacccgtcagatggtcgatgaattgatcgctgacattgcggccgccaataaagaagctgcggcaccgagcgatacggccaag

SEQ ID NO: 830 - protein, 389 aa, Artificial Sequence
  Variant of Leucine Decarboxylase from Planctomycetaceae bacterium
MGNLKFPDGALSPTDQRRIEDVYQYVREQCDTFIGYPCNMHFDYTPLFPFLAYPVNNVGDPFASSNYRIHTREIEREVLAWFAELMHIAPEEYWGYVTNGGSEGNLYGGFLARERFPDGVAYFSEDSHYSVYKNLRLLNMRHIMIKSQPNGEIDYGDLYETMRAHRDKPAIIFANIGTTMTEGIDNVRTIQDMFKKLAIHESHIHCDAALSGMTLPFMDDAPAFDFATGIDSLSISGHKFIGSPMPCGIVLTRKPYVEKIATSIEYIGTRDTTISGSRNGITPLFLWYAVKQAGRDGFKKRVAACLDNARYAVEQFKRIGVEAMRNPCAITVVFPKPPQSVLEKWQIATEGDDAHICLMPSTTRQMVDELIADIAAANKEAAAPSDTAK

SEQ ID NO: 831 - DNA, 1167 bp, Artificial Sequence
  Variant of Leucine Decarboxylase from Planctomycetaceae bacterium
atgggtaatctgaaatttccagatggcgcgttgagcccgaccgaccaacgccgtattgaagatgtgtatcagtacgttcgtgagcaatgcgacaccttcatcgggtatccgtgcaacatgcactttgattacacacctctttttccgttcctggcctatcccgtcaacaacgtgggcgatccgtttgcaagctccagttatcgcatccatacccgtgaaatcgaacgcgaggttctggcgtggttcgccgaactcatgcacattgcaccagaagaatactggggttatgtgactaatggaggatcggagggcaacctgtacggtggctttttagcgcgtgaacgctttcctactggcgtcgcctacttctcggaagattcgcattatagcgtgtataagaatctgcgtctgctgaacatgcgtcacatcatgatcaaatcacagccgaatggtgagattgattacggcgatctctacgaaactatgcgcgctcatcgtgataagccggcaatcatctttgctaacattggtacgacgatgaccgaaggcattgacaacgtgcgcaccatccaggatatgttcaagaagctggcgattcacgaatctcatatccattgtgacgcagcattatcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatatcggtacccgcgacactacgatttcgggcagccgtaatggtattacaccgctgtttctttggtacgcggtgaaacaagctggacgcgagggcttcaaaaagcgtgttgcggcatgtctggataacgcccgctatgccgtcgagcagtttaaacgcatcggtgtagaagcgatgcgtaatccatgtgccattaccgttgtgttcccgaaacctccgcagtcagtgctggaaaagtggcaaatcgcaaccgagggcgacgatgcgcatatttgcttaatgccaagtaccacccgtcagatggtcgatgaattgatcgctgacattgcggccgccaataaagaagctgcggcaccgagcgatacggccaag

SEQ ID NO: 832 - protein, 389 aa, Artificial Sequence
  Variant of Leucine Decarboxylase from Planctomycetaceae bacterium
MGNLKFPDGALSPTDQRRIEDVYQYVREQCDTFIGYPCNMHFDYTPLFPFLAYPVNNVGDPFASSSYRIHTREIEREVLAWFAELMHIAPEEYWGYVTNGGSEGNLYGGFLARERFPTGVAYFSEDSHYSVYKNLRLLNMRHIMIKSQPNGEIDYGDLYETMRAHRDKPAIIFANIGTTMTEGIDNVRTIQDMFKKLAIHESHIHCDAALSGMTLPFMDDAPAFDFATGIDSLSISGHKFIGSPMPCGIVLTRKPYVEKIATSIEYIGTRDTTISGSRNGITPLFLWYAVKQAGREGFKKRVAACLDNARYAVEQFKRIGVEAMRNPCAITVVFPKPPQSVLEKWQIATEGDDAHICLMPSTTRQMVDELIADIAAANKEAAAPSDTAK

SEQ ID NO: 833 - DNA, 1167 bp, Artificial Sequence
  Variant of Leucine Decarboxylase from Planctomycetaceae bacterium
atgggtaatctgaaatttccagatggcgcgttgagcccgaccgaccaacgccgtattgaagatgtgtatcagtacgttcgtgagcaatgcgacaccttcatcgggtatccgtgcaacatgcactttgattacacacctctttttccgttcctggcctatcccgtcaacaacgtgggcgatccgtttgcaagctccaattatcgcatccatacccgtgaaatcgaacgcgaggttctggcgtggttcgccgaactcatgcacattgcaccagaagaatactggggttatgtgactaatggaggatcggagggcaacctgtacggtggctttttagcgcgtgaacgctttcctgacggcgtcgcctacttctcggaagattcgcattatagcgtgtataagaatctgcgtctgctgaacatgcgtcacatcatgatcaaatcacagccgaatggtgagattgattacggcgatctctacgaaactatgcgcgctcatcgtgataagccggcaatcatctttgctaacattggtacgacgatgaccgaaggcattgacaacgtgcgcaccatccaggatatgttcaagaagctggcgattcacgaatctcatatccattgtgacgcagcattatcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatatcggtacccgcgacactacgatttcgggcagccgtaatggtattacaccgctgtttctttggtacgcggtgaaacaagctggacgcgagggcttcaaacgccgtgttgcggcatgtctggataacgcccgctatgccgtcgagcagtttaaacgcatcggtgtagaagcgatgcgtaatccatgtgccattaccgttgtgttcccgaaacctccgcagtcagtgctggaaaagtggcaaatcgcaaccgagggcgacgatgcgcatatttgcttaatgccaagtaccacccgtcagatggtcgatgaattgatcgctgacattgcggccgccaataaagaagctgcggcaccgagcgatacggccaag

SEQ ID NO: 834 - protein, 389 aa, Artificial Sequence
  Variant of Leucine Decarboxylase from Planctomycetaceae bacterium
MGNLKFPDGALSPTDQRRIEDVYQYVREQCDTFIGYPCNMHFDYTPLFPFLAYPVNNVGDPFASSNYRIHTREIEREVLAWFAELMHIAPEEYWGYVTNGGSEGNLYGGFLARERFPDGVAYFSEDSHYSVYKNLRLLNMRHIMIKSQPNGEIDYGDLYETMRAHRDKPAIIFANIGTTMTEGIDNVRTIQDMFKKLAIHESHIHCDAALSGMTLPFMDDAPAFDFATGIDSLSISGHKFIGSPMPCGIVLTRKPYVEKIATSIEYIGTRDTTISGSRNGITPLFLWYAVKQAGREGFKRRVAACLDNARYAVEQFKRIGVEAMRNPCAITVVFPKPPQSVLEKWQIATEGDDAHICLMPSTTRQMVDELIADIAAANKEAAAPSDTAK

SEQ ID NO: 835 - DNA, 1167 bp, Artificial Sequence
  Variant of Leucine Decarboxylase from Planctomycetaceae bacterium
atgggtaatctgaaatttccagatggcgcgttgagcccgaccgaccaacgccgtattgaagatgtgtatcagtacgttcgtgagcaatgcgacaccttcatcgggtatccgtgcaacatgcactttgattacacacctctttttccgttcctggcctatcccgtcaacaacgtgggcgatccgtttgcaagctccagttatcgcatccatacccgtgaaatcgaacgcgaggttctggcgtggttcgccgaactcatgcacattgcaccagaagaatactggggttatgtgactaatggaggatcggagggcaacctgtacggtggctttttagcgcgtgaacgctttcctactggcgtcgcctacttctcggaagattcgcattatagcgtgtataagaatctgcgtctgctgaacatgcgtcacatcatgatcaaatcacagccgaatggtgagattgattacggcgatctctacgaaactatgcgcgctcatcgtgataagccggcaatcatctttgctaacattggtacgacgatgaccgaaggcattgacaacgtgcgcaccatccaggatatgttcaagaagctggcgattcacgaatctcatatccattgtgacgcagcattatcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatatcggtacccgcgacactacgatttcgggcagccgtaatggtattacaccgctgtttctttggtacgcggtgaaacaagctggacgcgacggcttcaaaaagcgtgttgcggcatgtctggataacgcccgctatgccgtcgagcagtttaaacgcatcggtgtagaagcgatgcgtaatccatgtgccattaccgttgtgttcccgaaacctccgcagtcagtgctggaaaagtggcaaatcgcaaccgagggcgacgatgcgcatatttgcttaatgccaagtaccacccgtcagatggtcgatgaattgatcgctgacattgcggccgccaataaagaagctgcggcaccgagcgatacggccaag

SEQ ID NO: 836 - protein, 389 aa, Artificial Sequence
  Variant of Leucine Decarboxylase from Planctomycetaceae bacterium
MGNLKFPDGALSPTDQRRIEDVYQYVREQCDTFIGYPCNMHFDYTPLFPFLAYPVNNVGDPFASSSYRIHTREIEREVLAWFAELMHIAPEEYWGYVTNGGSEGNLYGGFLARERFPTGVAYFSEDSHYSVYKNLRLLNMRHIMIKSQPNGEIDYGDLYETMRAHRDKPAIIFANIGTTMTEGIDNVRTIQDMFKKLAIHESHIHCDAALSGMTLPFMDDAPAFDFATGIDSLSISGHKFIGSPMPCGIVLTRKPYVEKIATSIEYIGTRDTTISGSRNGITPLFLWYAVKQAGRDGFKKRVAACLDNARYAVEQFKRIGVEAMRNPCAITVVFPKPPQSVLEKWQIATEGDDAHICLMPSTTRQMVDELIADIAAANKEAAAPSDTAK

SEQ ID NO: 837 - DNA, 1167 bp, Artificial Sequence
  Variant of Leucine Decarboxylase from Planctomycetaceae bacterium
atgggtaatctgaaatttccagatggcgcgttgagcccgaccgaccaacgccgtattgaagatgtgtatcagtacgttcgtgagcaatgcgacaccttcatcgggtatccgtgcaacatgcactttgattacacacctctttttccgttcctggcctatcccgtcaacaacgtgggcgatccgtttgcaagctccaattatcgcatccatacccgtgaaatcgaacgcgaggttctggcgtggttcgccgaactcatgcacattgcaccagaagaatactggggttatgtgactaatggaggatcggagggcaacctgtacggtggctttttagcgcgtgaacgctttcctgacggcgtcgcctacttctcggaagattcgcattatagcgtgtataagaatctgcgtctgctgaacatgcgtcacatcatgatcaaatcacagccgaatggtgagattgattacggcgatctctacgaaactatgcgcgctcatcgtgataagccggcaatcatctttgctaacattggtacgacgatgaccgaaggcattgacaacgtgcgcaccatccaggatatgttcaagaagctggcgattcacgaatctcatatccattgtgacgcagcattatcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatatcggtacccgcgacactacgatttcgggcagccgtaatggtattacaccgctgtttctttggtacgcggtgaaacaagctggacgcgacggcttcaaacgccgtgttgcggcatgtctggataacgcccgctatgccgtcgagcagtttaaacgcatcggtgtagaagcgatgcgtaatccatgtgccattaccgttgtgttcccgaaacctccgcagtcagtgctggaaaagtggcaaatcgcaaccgagggcgacgatgcgcatatttgcttaatgccaagtaccacccgtcagatggtcgatgaattgatcgctgacattgcggccgccaataaagaagctgcggcaccgagcgatacggccaag

SEQ ID NO: 838 - protein, 389 aa, Artificial Sequence
  Variant of Leucine Decarboxylase from Planctomycetaceae bacterium
MGNLKFPDGALSPTDQRRIEDVYQYVREQCDTFIGYPCNMHFDYTPLFPFLAYPVNNVGDPFASSNYRIHTREIEREVLAWFAELMHIAPEEYWGYVTNGGSEGNLYGGFLARERFPDGVAYFSEDSHYSVYKNLRLLNMRHIMIKSQPNGEIDYGDLYETMRAHRDKPAIIFANIGTTMTEGIDNVRTIQDMFKKLAIHESHIHCDAALSGMTLPFMDDAPAFDFATGIDSLSISGHKFIGSPMPCGIVLTRKPYVEKIATSIEYIGTRDTTISGSRNGITPLFLWYAVKQAGRDGFKRRVAACLDNARYAVEQFKRIGVEAMRNPCAITVVFPKPPQSVLEKWQIATEGDDAHICLMPSTTRQMVDELIADIAAANKEAAAPSDTAK

SEQ ID NO: 839 - DNA, 1167 bp, Artificial Sequence
  Variant of Leucine Decarboxylase from Planctomycetaceae bacterium
atgggtaatctgaaatttccagatggcgcgttgagcccgaccgaccaacgccgtattgaagatgtgtatcagtacgttcgtgagcaatgcgacaccttcatcgggtatccgtgcaacatgcactttgattacacacctctttttccgttcctggcctatcccgtcaacaacgtgggcgatccgtttgcaagctccagttatcgcatccatacccgtgaaatcgaacgcgaggttctggcgtggttcgccgaactcatgcacattgcaccagaagaatactggggttatgtgactaatggaggatcggagggcaacctgtacggtggctttttagcgcgtgaacgctttcctgacggcgtcgcctacttctcggaagattcgcattatagcgtgtataagaatctgcgtctgctgaacatgcgtcacatcatgatcaaatcacagccgaatggtgagattgattacggcgatctctacgaaactatgcgcgctcatcgtgataagccggcaatcatctttgctaacattggtacgacgatgaccgaaggcattgacaacgtgcgcaccatccaggatatgttcaagaagctggcgattcacgaatctcatatccattgtgacgcagcattatcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatatcggtacccgcgacactacgatttcgggcagccgtaatggtattacaccgctgtttctttggtacgcggtgaaacaagctggacgcgacggcttcaaacgccgtgttgcggcatgtctggataacgcccgctatgccgtcgagcagtttaaacgcatcggtgtagaagcgatgcgtaatccatgtgccattaccgttgtgttcccgaaacctccgcagtcagtgctggaaaagtggcaaatcgcaaccgagggcgacgatgcgcatatttgcttaatgccaagtaccacccgtcagatggtcgatgaattgatcgctgacattgcggccgccaataaagaagctgcggcaccgagcgatacggccaag

SEQ ID NO: 840 - protein, 389 aa, Artificial Sequence
  Variant of Leucine Decarboxylase from Planctomycetaceae bacterium
MGNLKFPDGALSPTDQRRIEDVYQYVREQCDTFIGYPCNMHFDYTPLFPFLAYPVNNVGDPFASSSYRIHTREIEREVLAWFAELMHIAPEEYWGYVTNGGSEGNLYGGFLARERFPDGVAYFSEDSHYSVYKNLRLLNMRHIMIKSQPNGEIDYGDLYETMRAHRDKPAIIFANIGTTMTEGIDNVRTIQDMFKKLAIHESHIHCDAALSGMTLPFMDDAPAFDFATGIDSLSISGHKFIGSPMPCGIVLTRKPYVEKIATSIEYIGTRDTTISGSRNGITPLFLWYAVKQAGRDGFKRRVAACLDNARYAVEQFKRIGVEAMRNPCAITVVFPKPPQSVLEKWQIATEGDDAHICLMPSTTRQMVDELIADIAAANKEAAAPSDTAK

SEQ ID NO: 841 - DNA, 1167 bp, Artificial Sequence
  Variant of Leucine Decarboxylase from Planctomycetaceae bacterium
atgggtaatctgaaatttccagatggcgcgttgagcccgaccgaccaacgccgtattgaagatgtgtatcagtacgttcgtgagcaatgcgacaccttcatcgggtatccgtgcaacatgcactttgattacacacctctttttccgttcctggcctatcccgtcaacaacgtgggcgatccgtttgcaagctccagttatcgcatccatacccgtgaaatcgaacgcgaggttctggcgtggttcgccgaactcatgcacattgcaccagaagaatactggggttatgtgactaatggaggatcggagggcaacctgtacggtggctttttagcgcgtgaacgctttcctgacggcgtcgcctacttctcggaagattcgcattatagcgtgtataagaatctgcgtctgctgaacatgcgtcacatcatgatcaaatcacagccgaatggtgagattgattacggcgatctctacgaaactatgcgcgctcatcgtgataagccggcaatcatctttgctaacattggtacgacgatgaccgaaggcattgacaacgtgcgcaccatccaggatatgttcaagaagctggcgattcacgaatctcatatccattgtgacgcagcattatcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatatcggtacccgcgacactacgatttcgggcagccgtaatggtattacaccgctgtttctttggtacgcggtgaaacaagctggacgcgacggcttcaaaaagcgtgttgcggcatgtctggataacgcccgctatgccgtcgagcagtttaaacgcatcggtgtagaagcgatgcgtaatccatgtgccattaccgttgtgttcccgaaacctccgcagtcagtgctggaaaagtggcaaatcgcaaccgagggcgacgatgcgcatatttgcttaatgccaagtaccacccgtcagatggtcgatgaattgatcgctgacattgcggccgccaataaagaagctgcggcaccgagcgatacggccaag

SEQ ID NO: 842 - protein, 389 aa, Artificial Sequence
  Variant of Leucine Decarboxylase from Planctomycetaceae bacterium
MGNLKFPDGALSPTDQRRIEDVYQYVREQCDTFIGYPCNMHFDYTPLFPFLAYPVNNVGDPFASSSYRIHTREIEREVLAWFAELMHIAPEEYWGYVTNGGSEGNLYGGFLARERFPDGVAYFSEDSHYSVYKNLRLLNMRHIMIKSQPNGEIDYGDLYETMRAHRDKPAIIFANIGTTMTEGIDNVRTIQDMFKKLAIHESHIHCDAALSGMTLPFMDDAPAFDFATGIDSLSISGHKFIGSPMPCGIVLTRKPYVEKIATSIEYIGTRDTTISGSRNGITPLFLWYAVKQAGRDGFKKRVAACLDNARYAVEQFKRIGVEAMRNPCAITVVFPKPPQSVLEKWQIATEGDDAHICLMPSTTRQMVDELIADIAAANKEAAAPSDTAK

SEQ ID NO: 843 - DNA, 1167 bp, Artificial Sequence
  Variant of Leucine Decarboxylase from Planctomycetaceae bacterium
atgggtaatctgaaatttccagatggcgcgttgagcccgaccgaccaacgccgtattgaagatgtgtatcagtacgttcgtgagcaatgcgacaccttcatcgggtatccgtgcaacatgcactttgattacacacctctttttccgttcctggcctatcccgtcaacaacgtgggcgatccgtttgcaagctccagttatcgcatccatacccgtgaaatcgaacgcgaggttctggcgtggttcgccgaactcatgcacattgcaccagaagaatactggggttatgtgactaatggaggatcggagggcaacctgtacggtggctttttagcgcgtgaacgctttcctgacggcgtcgcctacttctcggaagattcgcattatagcgtgtataagaatctgcgtctgctgaacatgcgtcacatcatgatcaaatcacagccgaatggtgagattgattacggcgatctctacgaaactatgcgcgctcatcgtgataagccggcaatcatctttgctaacattggtacgacgatgaccgaaggcattgacaacgtgcgcaccatccaggatatgttcaagaagctggcgattcacgaatctcatatccattgtgacgcagcattatcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatatcggtacccgcgacactacgatttcgggcagccgtaatggtattacaccgctgtttctttggtacgcggtgaaacaagctggacgcgagggcttcaaacgccgtgttgcggcatgtctggataacgcccgctatgccgtcgagcagtttaaacgcatcggtgtagaagcgatgcgtaatccatgtgccattaccgttgtgttcccgaaacctccgcagtcagtgctggaaaagtggcaaatcgcaaccgagggcgacgatgcgcatatttgcttaatgccaagtaccacccgtcagatggtcgatgaattgatcgctgacattgcggccgccaataaagaagctgcggcaccgagcgatacggccaag

SEQ ID NO: 844 - protein, 389 aa, Artificial Sequence
  Variant of Leucine Decarboxylase from Planctomycetaceae bacterium
MGNLKFPDGALSPTDQRRIEDVYQYVREQCDTFIGYPCNMHFDYTPLFPFLAYPVNNVGDPFASSSYRIHTREIEREVLAWFAELMHIAPEEYWGYVTNGGSEGNLYGGFLARERFPDGVAYFSEDSHYSVYKNLRLLNMRHIMIKSQPNGEIDYGDLYETMRAHRDKPAIIFANIGTTMTEGIDNVRTIQDMFKKLAIHESHIHCDAALSGMTLPFMDDAPAFDFATGIDSLSISGHKFIGSPMPCGIVLTRKPYVEKIATSIEYIGTRDTTISGSRNGITPLFLWYAVKQAGREGFKRRVAACLDNARYAVEQFKRIGVEAMRNPCAITVVFPKPPQSVLEKWQIATEGDDAHICLMPSTTRQMVDELIADIAAANKEAAAPSDTAK

SEQ ID NO: 845 - DNA, 1167 bp, Artificial Sequence
  Variant of Leucine Decarboxylase from Planctomycetaceae bacterium
atgggtaatctgaaatttccagatggcgcgttgagcccgaccgaccaacgccgtattgaagatgtgtatcagtacgttcgtgagcaatgcgacaccttcatcgggtatccgtgcaacatgcactttgattacacacctctttttccgttcctggcctatcccgtcaacaacgtgggcgatccgtttgcaagctccaattatcgcatccatacccgtgaaatcgaacgcgaggttctggcgtggttcgccgaactcatgcacattgcaccagaagaatactggggttatgtgactaatggaggatcggagggcaacctgtacggtggctttttagcgcgtgaacgctttcctactggcgtcgcctacttctcggaagattcgcattatagcgtgtataagaatctgcgtctgctgaacatgcgtcacatcatgatcaaatcacagccgaatggtgagattgattacggcgatctctacgaaactatgcgcgctcatcgtgataagccggcaatcatctttgctaacattggtacgacgatgaccgaaggcattgacaacgtgcgcaccatccaggatatgttcaagaagctggcgattcacgaatctcatatccattgtgacgcagcattatcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatatcggtacccgcgacactacgatttcgggcagccgtaatggtattacaccgctgtttctttggtacgcggtgaaacaagctggacgcgacggcttcaaaaagcgtgttgcggcatgtctggataacgcccgctatgccgtcgagcagtttaaacgcatcggtgtagaagcgatgcgtaatccatgtgccattaccgttgtgttcccgaaacctccgcagtcagtgctggaaaagtggcaaatcgcaaccgagggcgacgatgcgcatatttgcttaatgccaagtaccacccgtcagatggtcgatgaattgatcgctgacattgcggccgccaataaagaagctgcggcaccgagcgatacggccaag

SEQ ID NO: 846 - protein, 389 aa, Artificial Sequence
  Variant of Leucine Decarboxylase from Planctomycetaceae bacterium
MGNLKFPDGALSPTDQRRIEDVYQYVREQCDTFIGYPCNMHFDYTPLFPFLAYPVNNVGDPFASSNYRIHTREIEREVLAWFAELMHIAPEEYWGYVTNGGSEGNLYGGFLARERFPTGVAYFSEDSHYSVYKNLRLLNMRHIMIKSQPNGEIDYGDLYETMRAHRDKPAIIFANIGTTMTEGIDNVRTIQDMFKKLAIHESHIHCDAALSGMTLPFMDDAPAFDFATGIDSLSISGHKFIGSPMPCGIVLTRKPYVEKIATSIEYIGTRDTTISGSRNGITPLFLWYAVKQAGRDGFKKRVAACLDNARYAVEQFKRIGVEAMRNPCAITVVFPKPPQSVLEKWQIATEGDDAHICLMPSTTRQMVDELIADIAAANKEAAAPSDTAK

SEQ ID NO: 847 - DNA, 1167 bp, Artificial Sequence
  Variant of Leucine Decarboxylase from Planctomycetaceae bacterium
atgggtaatctgaaatttccagatggcgcgttgagcccgaccgaccaacgccgtattgaagatgtgtatcagtacgttcgtgagcaatgcgacaccttcatcgggtatccgtgcaacatgcactttgattacacacctctttttccgttcctggcctatcccgtcaacaacgtgggcgatccgtttgcaagctccagttatcgcatccatacccgtgaaatcgaacgcgaggttctggcgtggttcgccgaactcatgcacattgcaccagaagaatactggggttatgtgactaatggaggatcggagggcaacctgtacggtggctttttagcgcgtgaacgctttcctactggcgtcgcctacttctcggaagattcgcattatagcgtgtataagaatctgcgtctgctgaacatgcgtcacatcatgatcaaatcacagccgaatggtgagattgattacggcgatctctacgaaactatgcgcgctcatcgtgataagccggcaatcatctttgctaacattggtacgacgatgaccgaaggcattgacaacgtgcgcaccatccaggatatgttcaagaagctggcgattcacgaatctcatatccattgtgacgcagcattatcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatatcggtacccgcgacactacgatttcgggcagccgtaatggtattacaccgctgtttctttggtacgcggtgaaacaagctggacgcgacggcttcaaacgccgtgttgcggcatgtctggataacgcccgctatgccgtcgagcagtttaaacgcatcggtgtagaagcgatgcgtaatccatgtgccattaccgttgtgttcccgaaacctccgcagtcagtgctggaaaagtggcaaatcgcaaccgagggcgacgatgcgcatatttgcttaatgccaagtaccacccgtcagatggtcgatgaattgatcgctgacattgcggccgccaataaagaagctgcggcaccgagcgatacggccaag

SEQ ID NO: 848 - protein, 389 aa, Artificial Sequence
  Variant of Leucine Decarboxylase from Planctomycetaceae bacterium
MGNLKFPDGALSPTDQRRIEDVYQYVREQCDTFIGYPCNMHFDYTPLFPFLAYPVNNVGDPFASSSYRIHTREIEREVLAWFAELMHIAPEEYWGYVTNGGSEGNLYGGFLARERFPTGVAYFSEDSHYSVYKNLRLLNMRHIMIKSQPNGEIDYGDLYETMRAHRDKPAIIFANIGTTMTEGIDNVRTIQDMFKKLAIHESHIHCDAALSGMTLPFMDDAPAFDFATGIDSLSISGHKFIGSPMPCGIVLTRKPYVEKIATSIEYIGTRDTTISGSRNGITPLFLWYAVKQAGRDGFKRRVAACLDNARYAVEQFKRIGVEAMRNPCAITVVFPKPPQSVLEKWQIATEGDDAHICLMPSTTRQMVDELIADIAAANKEAAAPSDTAK

SEQ ID NO: 849 - DNA, 1167 bp, Artificial Sequence
  Variant of Leucine Decarboxylase from Planctomycetaceae bacterium
atgggtaatctgaaatttccagatggcgcgttgagcccgaccgaccaacgccgtattgaagatgtgtatcagtacgttcgtgagcaatgcgacaccttcatcgggtatccgtgcaacatgcactttgattacacacctctttttccgttcctggcctatcccgtcaacaacgtgggcgatccgtttgcaagctccagttatcgcatccatacccgtgaaatcgaacgcgaggttctggcgtggttcgccgaactcatgcacattgcaccagaagaatactggggttatgtgactaatggaggatcggagggcaacctgtacggtggctttttagcgcgtgaacgctttcctactggcgtcgcctacttctcggaagattcgcattatagcgtgtataagaatctgcgtctgctgaacatgcgtcacatcatgatcaaatcacagccgaatggtgagattgattacggcgatctctacgaaactatgcgcgctcatcgtgataagccggcaatcatctttgctaacattggtacgacgatgaccgaaggcattgacaacgtgcgcaccatccaggatatgttcaagaagctggcgattcacgaatctcatatccattgtgacgcagcattatcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatatcggtacccgcgacactacgatttcgggcagccgtaatggtattacaccgctgtttctttggtacgcggtgaaacaagctggacgcgagggcttcaaacgccgtgttgcggcatgtctggataacgcccgctatgccgtcgagcagtttaaacgcatcggtgtagaagcgatgcgtaatccatgtgccattaccgttgtgttcccgaaacctccgcagtcagtgctggaaaagtggcaaatcgcaaccgagggcgacgatgcgcatatttgcttaatgccaagtaccacccgtcagatggtcgatgaattgatcgctgacattgcggccgccaataaagaagctgcggcaccgagcgatacggccaag

SEQ ID NO: 850 - protein, 389 aa, Artificial Sequence
  Variant of Leucine Decarboxylase from Planctomycetaceae bacterium
MGNLKFPDGALSPTDQRRIEDVYQYVREQCDTFIGYPCNMHFDYTPLFPFLAYPVNNVGDPFASSSYRIHTREIEREVLAWFAELMHIAPEEYWGYVTNGGSEGNLYGGFLARERFPTGVAYFSEDSHYSVYKNLRLLNMRHIMIKSQPNGEIDYGDLYETMRAHRDKPAIIFANIGTTMTEGIDNVRTIQDMFKKLAIHESHIHCDAALSGMTLPFMDDAPAFDFATGIDSLSISGHKFIGSPMPCGIVLTRKPYVEKIATSIEYIGTRDTTISGSRNGITPLFLWYAVKQAGREGFKRRVAACLDNARYAVEQFKRIGVEAMRNPCAITVVFPKPPQSVLEKWQIATEGDDAHICLMPSTTRQMVDELIADIAAANKEAAAPSDTAK

SEQ ID NO: 851 - DNA, 1167 bp, Artificial Sequence
  Variant of Leucine Decarboxylase from Planctomycetaceae bacterium
atgggtaatctgaaatttccagatggcgcgttgagcccgaccgaccaacgccgtattgaagatgtgtatcagtacgttcgtgagcaatgcgacaccttcatcgggtatccgtgcaacatgcactttgattacacacctctttttccgttcctggcctatcccgtcaacaacgtgggcgatccgtttgcaagctccaattatcgcatccatacccgtgaaatcgaacgcgaggttctggcgtggttcgccgaactcatgcacattgcaccagaagaatactggggttatgtgactaatggaggatcggagggcaacctgtacggtggctttttagcgcgtgaacgctttcctactggcgtcgcctacttctcggaagattcgcattatagcgtgtataagaatctgcgtctgctgaacatgcgtcacatcatgatcaaatcacagccgaatggtgagattgattacggcgatctctacgaaactatgcgcgctcatcgtgataagccggcaatcatctttgctaacattggtacgacgatgaccgaaggcattgacaacgtgcgcaccatccaggatatgttcaagaagctggcgattcacgaatctcatatccattgtgacgcagcattatcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatatcggtacccgcgacactacgatttcgggcagccgtaatggtattacaccgctgtttctttggtacgcggtgaaacaagctggacgcgacggcttcaaacgccgtgttgcggcatgtctggataacgcccgctatgccgtcgagcagtttaaacgcatcggtgtagaagcgatgcgtaatccatgtgccattaccgttgtgttcccgaaacctccgcagtcagtgctggaaaagtggcaaatcgcaaccgagggcgacgatgcgcatatttgcttaatgccaagtaccacccgtcagatggtcgatgaattgatcgctgacattgcggccgccaataaagaagctgcggcaccgagcgatacggccaag

SEQ ID NO: 852 - protein, 389 aa, Artificial Sequence
  Variant of Leucine Decarboxylase from Planctomycetaceae bacterium
MGNLKFPDGALSPTDQRRIEDVYQYVREQCDTFIGYPCNMHFDYTPLFPFLAYPVNNVGDPFASSNYRIHTREIEREVLAWFAELMHIAPEEYWGYVTNGGSEGNLYGGFLARERFPTGVAYFSEDSHYSVYKNLRLLNMRHIMIKSQPNGEIDYGDLYETMRAHRDKPAIIFANIGTTMTEGIDNVRTIQDMFKKLAIHESHIHCDAALSGMTLPFMDDAPAFDFATGIDSLSISGHKFIGSPMPCGIVLTRKPYVEKIATSIEYIGTRDTTISGSRNGITPLFLWYAVKQAGRDGFKRRVAACLDNARYAVEQFKRIGVEAMRNPCAITVVFPKPPQSVLEKWQIATEGDDAHICLMPSTTRQMVDELIADIAAANKEAAAPSDTAK

We claim:

1. An engineered leucine decarboxylase polypeptide comprising an amino acid sequence having at least 90%, 91%, 92,%, 93%, 94%, 95%, 96%, 97%, 98%, 99%, or more sequence identity to the entire sequence set forth in SEQ ID NO: 12, wherein the amino acid positions of said amino acid sequence are numbered with reference to the amino acid sequence of SEQ ID NO: 12, and wherein said amino acid sequence comprises a substitution at position 364, selected from L364K and L364R.

2. The engineered leucine decarboxylase polypeptide of claim 1, wherein said engineered leucine decarboxylase polypeptide exhibits more activity on leucine than the leucine decarboxylase polypeptide set forth in SEQ ID NO: 12.

3. The engineered leucine decarboxylase polypeptide of claim 1, wherein said engineered leucine decarboxylase polypeptide is more resistant to proteolysis than the leucine decarboxylase polypeptide set forth in SEQ ID NO: 12.

4. The engineered leucine decarboxylase polypeptide of claim 1, wherein said engineered leucine decarboxylase polypeptide is more thermostable than the leucine decarboxylase polypeptide set forth in SEQ ID NO: 12.

5. The engineered leucine decarboxylase polypeptide of claim 1, wherein said engineered leucine decarboxylase polypeptide has been isolated from a recombinant expression host.

6. A composition comprising at least one engineered leucine decarboxylase polypeptide provided in claim 1.

* * * * *